(12) United States Patent
Hemminki et al.

(10) Patent No.: US 10,647,963 B2
(45) Date of Patent: May 12, 2020

(54) ENHANCED ADOPTIVE CELL THERAPY

(71) Applicant: TILT Biotherapeutics Oy, Helsinki (FI)

(72) Inventors: Akseli Hemminki, Helsinki (FI); Markus Vaha-Koskela, Masala (FI); Siri Tahtinen, Helsinki (FI); Vincenzo Cerullo, Helsinki (FI)

(73) Assignee: TILT BIOTHERAPEUTICS OY, Helsinki (FI)

( * ) Notice: Subject to any disclaimer, the term of this patent is extended or adjusted under 35 U.S.C. 154(b) by 272 days.

(21) Appl. No.: 14/254,235

(22) Filed: Apr. 16, 2014

(65) Prior Publication Data
US 2015/0232880 A1    Aug. 20, 2015

(30) Foreign Application Priority Data
Apr. 18, 2013 (FI) .................... 20135387

(51) Int. Cl.
| | | |
|---|---|---|
| *C12N 7/00* | (2006.01) | |
| *A61K 35/17* | (2015.01) | |
| *C07K 14/525* | (2006.01) | |
| *A61K 35/76* | (2015.01) | |
| *C07K 14/47* | (2006.01) | |
| *A61K 35/761* | (2015.01) | |
| *C07K 14/55* | (2006.01) | |
| *C07K 14/565* | (2006.01) | |
| *C07K 14/57* | (2006.01) | |
| *C07K 14/52* | (2006.01) | |
| *C12N 15/86* | (2006.01) | |
| *A61K 48/00* | (2006.01) | |
| *A61K 35/12* | (2015.01) | |

(52) U.S. Cl.
CPC .............. *C12N 7/00* (2013.01); *A61K 35/17* (2013.01); *A61K 35/76* (2013.01); *A61K 35/761* (2013.01); *C07K 14/472* (2013.01); *C07K 14/52* (2013.01); *C07K 14/525* (2013.01); *C07K 14/55* (2013.01); *C07K 14/565* (2013.01); *C07K 14/57* (2013.01); *C12N 15/86* (2013.01); *A61K 48/00* (2013.01); *A61K 2035/124* (2013.01); *C12N 2710/10032* (2013.01); *C12N 2710/10041* (2013.01); *C12N 2710/10043* (2013.01)

(58) Field of Classification Search
CPC .............. C12N 7/00; C12N 15/86; C12N 2710/10032; C12N 2710/10041; C12N 2710/10043; A61K 35/17; A61K 35/76; A61K 35/761; A61K 48/00; A61K 2035/124; C07K 14/472; C07K 14/52; C07K 14/525; C07K 14/55; C07K 14/565; C07K 14/57
See application file for complete search history.

(56) References Cited

U.S. PATENT DOCUMENTS

| | | | |
|---|---|---|---|
| 5,126,132 A | 6/1992 | Rosenberg | |
| 6,210,963 B1 | 4/2001 | Haddada | |
| 2003/0194804 A1 | 10/2003 | Lamb et al. | |
| 2006/0263882 A1* | 11/2006 | Fazio | C12N 15/85 435/455 |
| 2011/0052530 A1* | 3/2011 | Dudley | A61K 31/675 424/85.2 |

FOREIGN PATENT DOCUMENTS

| | | | | |
|---|---|---|---|---|
| CN | 102154213 A | 8/2011 | | |
| CN | 102264760 A | 11/2011 | | |
| FI | 2011618 A | 11/2011 | | |
| JP | 2005-507248 A | 3/2005 | | |
| JP | 2009-525989 A | 7/2009 | | |
| JP | 2012-513209 A | 6/2012 | | |
| JP | 2012-516682 A | 7/2012 | | |
| WO | 0224933 A2 | 3/2002 | | |
| WO | WO 03/031630 A1 | 4/2003 | | |
| WO | WO 2007/068772 A1 | 6/2007 | | |
| WO | WO 2007/093036 A1 | 8/2007 | | |
| WO | WO 2010072900 A1 * | 7/2010 | ........... | C07K 14/535 |
| WO | WO 2010/086838 A2 | 8/2010 | | |
| WO | WO 2010086838 A2 * | 8/2010 | ............... | C12N 7/00 |
| WO | WO 2012/038607 A1 | 3/2012 | | |
| WO | WO 2012/122444 A1 | 9/2012 | | |
| WO | 2012136231 A1 | 10/2012 | | |

OTHER PUBLICATIONS

Hoffman et al., World J. Gastroenterol., 13(22): 3063-3070, 2007.*
Slos et al., Cancer Gene Therapy, 8(5): 321-332, 2001.*
Wright et al., Cancer Biotherapy & Radiopharmaceuticals, 14(1): 49-57, 1999.*
Sirena et al., Virology: (343): 283-298, 2005.*
Cerullo et al., Cancer Res; 70(11); 4297-309, 2010.*
FI20135387 Search Report; National Board of Patents and Registration of Finland; dated Dec. 20, 2013.
Yang, Zhi; Combined Therapy with Cytokine-Induced Killer Cells and Oncolytic Adenovirus Expressing IL-12 Induce Enhanced Antitumor Activity in Liver Tumor Model; PLoS One, vol. 7, Issue 9, Sep. 18, 2012, pp. 1-11 [online], retrieved on Dec. 18, 2013].

(Continued)

*Primary Examiner* — Thaian N. Ton
(74) *Attorney, Agent, or Firm* — Birch, Stewart, Kolasch & Birch, LLP

(57) ABSTRACT

The present invention relates to the fields of life sciences and medicine. Specifically, the invention relates to cancer therapies of humans. More specifically, the present invention relates to oncolytic adenoviral vectors alone or together with therapeutic compositions for therapeutic uses and therapeutic methods for cancer. In one aspect the present invention relates to separate administration of adoptive cell therapeutic composition and oncolytic adenoviral vectors. Furthermore, the present invention relates to a pharmaceutical kit and a pharmaceutical composition, both utilizing oncolytic adenoviral vectors.

24 Claims, 34 Drawing Sheets
Specification includes a Sequence Listing.

(56) References Cited

OTHER PUBLICATIONS

Diaconu, Julia, et al; "Immune Response is an Important Aspect of the Antitumor Effect Produced by a CD40L-Encoding Oncolytic Adenovirus"; Cancer Research 2012; 72-2327-2338; Published Online First Mar. 6, 2012.
Burgert Hans-Gerhard, et al; "An Adenovirus Type 2 Glycoprotein Blocks Cell Surface Expression of Human Histocompatibility Class I Antigens"; Cell; vol. 41, 967-997, Jul. 1985.
Andersson, Mats, et al; Reduced Allorecognition of Adenovirus-2 Infected Cells; The Journal of Immunology; vol. 138, 3960-3966, No. 11, Jun. 1, 1987.
Andersson, Mats, et al; Impaired Intracellular Transport of Class 1 MHC Antigens as a Possible Means for Adenoviruses to Evade Immune Surveillance; Cell, vol. 43, 215-222, Nov. 1985.
Young, Anna-Mary, et al; Failure of Translation of Human Adenovirus mRNA in Murine Cancer Cells can be Partially Overcome by L4-100K Expression In Vitro and In Vivo, www.moleculartherapy.org; vol. 20., No. 9, 1676-1688; Sep. 2012.
Wold, William SM, et al; Immune responses to Adenoviruses; viral evasion mechanisms and their implications for the clinic; Immunology, 1999; pp. 380-385.
Street, Daron, et al; Interferon-y Enhances Susceptibility of Cervical Cancer Cells to Lysis by Tumor-Specific Cytotoxic T Cells; Gynecologic Oncology 65, 265-272 (1997) Article No. GO974667.
Song, Xiao-Tong, et al; "A Th 1-inducing Adenoviral Vaccine for Boostong Adoptively Transferred T Cells"; Original Article—The American Society of Gene & Cell Therapy; Molecular Therapy, vol. 19, No. 1, 211-217; Jan. 2011.
Schroder, Kate, et al; "Interferon-y: an overview of signals, mechanisms and functions"; Journal of Lenkocyte Biology, vol. 25, pp. 163-189; Feb. 2004.
Propper, David J., et al; "Low-Dose IFN-y Induces Tumor MHC Expression in Metastatic Malignant Melanoma"; Clinical Cancer Research 2003; 9:84-92.
Lugade, Amit, et al; "Radiation-Induced IFN-y Production within the Tumor Microenvironment Influences Antitumor Immunity"; J Immunol 2008; 180-3132-3139; doi: 10.4049/jimmunol.180.5.3132; http://www.jimmunol.org/content/180/5/3132.
Kraty, Wolfgang, et al; Direct activation of antigen-presenting cells is required for CD8+ T-cell priming and tumor vaccination; PNAS; Oct. 18, 2011 vol. 108; No. 42; 17414-17419; www.pnas.org/cgi/doi/10.1073/pnas.1108945108.
Espevik, Terje, et al; "A highly sensitive cell line, WEHI 164 clone 13, for measuring cytotoxic factor/tumor necrosis factor from human monocytes"; Journal ofImmunological Methods, 95 (1986) 99-105 Elsevier.
Ekkens,Melinda J., et al; "Th1 and Th2 Cells Help CD8 T-Cell Responses"; Infection and Immunity, May 2007, p. 2291-2296 vol. 75 No. 5; downloaded from http://iai.asm.org/ on May 16, 2014 by Helsinki University Library.
Form PCT/ISA/206 with annex of PCT/EP2014/057776 dated on Jul. 17, 2014, 4 pages.
Hernandez-Alcoceba R. et al. Cytokines for the treatment of gastrointestinal cancers: clinical experience and new perspectives. Expert Opinion on Investigational Drugs, Ashley Publ. Ltd., London, GB vol. 22. No. 7 Jan. 1, 2013,pp. 827-841.
Pegram, H. J. et al. Tumor-targeted T cells modified to secrete IL-12 eradicate systemic tumors without need for prior conditioning. Blood, vol. 119—No. 18, Feb. 21, 2012, pp. 4133-4141.
Snook, A.E. et al. GUCY2C-targeted cancer immunotherapy: past, present and future. Immunol. Res. 51:161-169. Oct. 30, 2011.
Fan, X. et al. Human Dendritic Cells Engineered to Secrete Interleukin-18 Activate MAGE-A3-Specific Cytotoxic T Lymphosytes in vitro. Immunological Investigations 41(5): 469-483, Jan. 1, 2012.
Bennet, Justin D., et al; "Regional Variation in the Lamina Propria T Cell Receptor V/3 Repertoire in Normal Human Colon"; Clinical Immunology vol. 90, No. 1, Jan. 1999, pp. 38-46.
Blair, Eric G., et al, "Restricted replication of human adenovirus type 5 in mouse cell lines"; Virus Research, 14 (1989) 339-346, Elesvier.
Bramante, Simona, et al; Serotype chimeric oncolytic adenovirus coding for GM-CSF treatment of sarcoma in rodents and humans; International Journal of Cancer; 00, 00-00 (2013).
Burgert Hans-Gerhard, et al; Immunomodulatory Functions Encoded by the E3 Transcription Unit of Adenoviruses; Virus Genes 21:1/2, 13-25, 2000.
Diaz, Maria, et al; "Oncolytic Immunovirotherapy for Melanoma Using Vesicular Stomatitis Virus"; Cancer Res 2007; 67:2840-2848; Downloaded from cancerres.aacrjournals.org on May 16, 2014.
Luo et al., "Treatment of Cancer with a Novel Dual-Targeted Conditionally Replicative Adenovirus Armed with mda-7/IL-24 Gene," Clin Cancer Res, Apr. 15, 2008, 14(8), pp. 2450-2457.
Kanerva et al., "Antiviral and Antitumor T-cell Immunity in Patients Treated with GM-CSF-Coding Oncolytic Adenovirus", Clinical Cancer Research, vol. 19, No. 10, May 15, 2013, pp. 2734-2744.
Stratagene Catalog, 1998, p. 39.
Sirena et al., "The nucleotide sequence and a first generation gene transfer vector of species B human adenovirus serotype 3", Virology 343, 2005, pp. 283-298.
Tähtinen et al., "Favorable Alteration of Tumor Microenvironment by Immunomodulatory Cytokines for Efficient T-Cell Therapy in Solid Tumors", PLOS One, 2015, pp. 1-20.
Svyatchenko et al, "Oncolytic Adenoviruses in Anti-Cancer Therapy: Current Status and Perspectives", МО ЛЕК УЛЯ РНА Я БИ ОЛ О ГИЯ , vol. 46, No. 4, Lerner Research Institute, 2012, pp. 556-569, with English abstract.
Gribben et al., "Unexpected Association between Induction of Immunity to the Universal Tumor Antigen CYP1B1 and Response to Next Therapy", Clin Cancer Res 2005; 11 (12), Jun. 15, 2005, pp. 4430-4436 (8 pages).
Havunen et al., "Abscopal Effect in Non-injected Tumors Achieved with Cytokine-Armed Oncolytic Adenovirus", Molecular Therapy: Oncolytics, vol. 11, Dec. 2018, pp. 109-121.
Lipinski et al., "Cancer Evolution and the Limits of Predictability in Precision Cancer Medicine", Trends in Cancer, vol. 2, No. 1, Jan. 2016, pp. 49-63.
Ellebaek et al., "Adoptive cell therapy with autologous tumor infiltrating lymphocytes and low-dose Interleukin-2 in metastatic melanoma patients", Journal of Translational Medicine, 2012, pp. 1-12.

\* cited by examiner a)
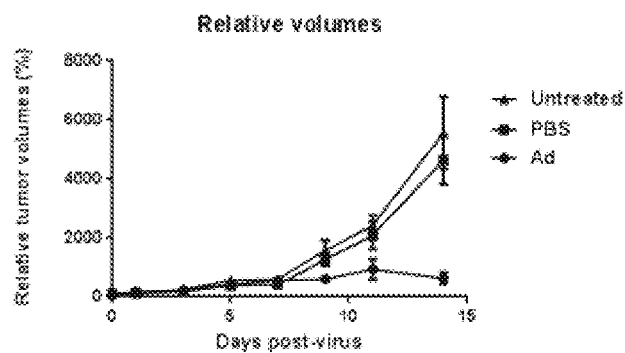
b)
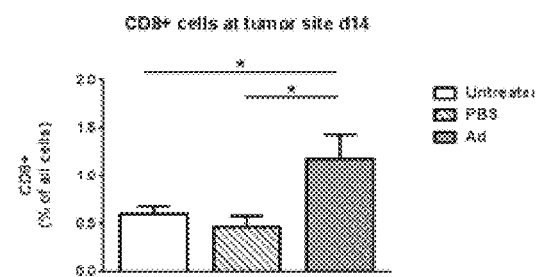
c)
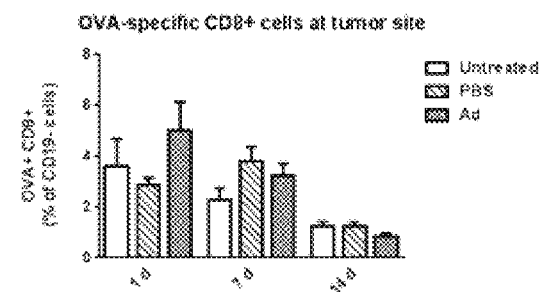
Figure 6.

a)
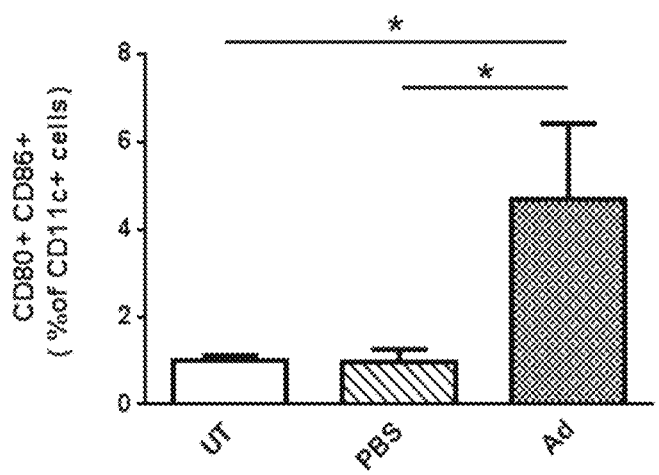
b)
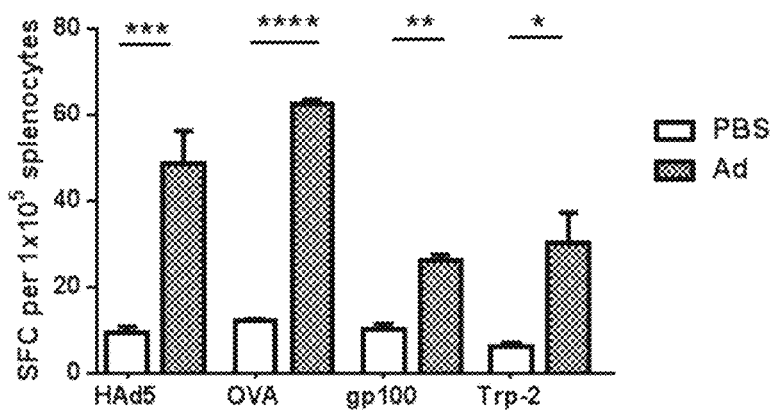
Figure 9.

a)
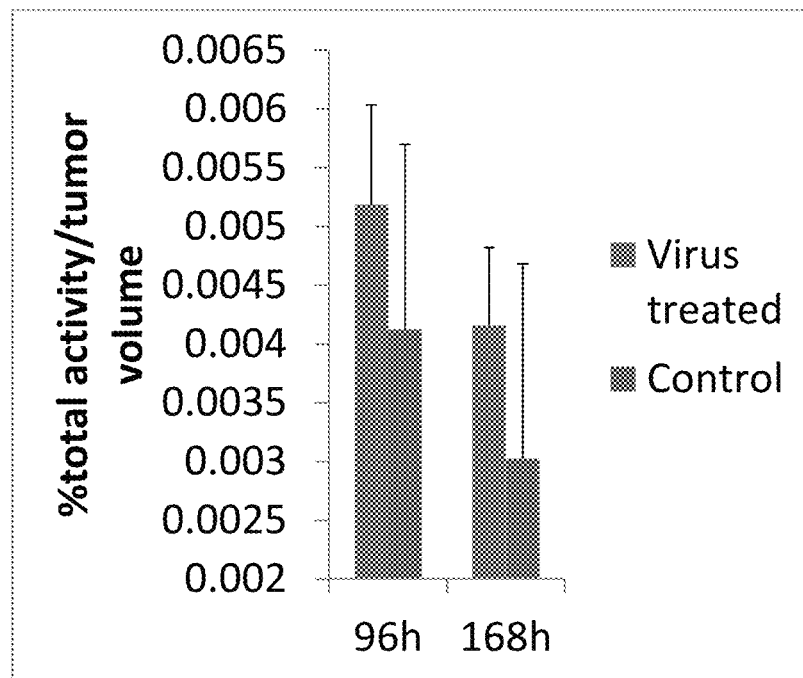
b)             c)
Figures 10a-c.

| | Number at risk | | | | | | | | |
|---|---|---|---|---|---|---|---|---|---|
| | Day 1 | Day 3 | Day 5 | Day 7 | Day 10 | Day 13 | Day 15 | Day 17 | Day 20 |
| No injection | 6 | 6 | 6 | 6 | 6 | 5 | 5 | 5 | 2 |
| No injection + OT1 | 6 | 6 | 6 | 6 | 5 | 5 | 5 | 5 | 3 |
| Ad5-Luc + OT1 | 5 | 5 | 5 | 5 | 5 | 5 | 5 | 4 | 4 |
| Ad-mTNFa + OT1 | 6 | 6 | 6 | 6 | 5 | 5 | 4 | 4 | 4 |
| Ad-mIFNg + OT1 | 5 | 5 | 5 | 5 | 5 | 5 | 5 | 5 | 4 |
| Ad-mIL2 + OT1 | 5 | 5 | 5 | 5 | 4 | 4 | 4 | 4 | 4 |
| Ad-mIFNb + OT1 | 5 | 5 | 5 | 5 | 5 | 5 | 5 | 5 | 5 |

| | Day 1 | Day 3 | Day 5 | Day 7 | Day 10 | Day 13 | Day 15 | Day 17 | Day 20 |
|---|---|---|---|---|---|---|---|---|---|
| Ad5-Luc | 6 | 6 | 6 | 6 | 6 | 6 | 5 | 5 | 4 |
| Ad-mTNFa | 5 | 5 | 5 | 5 | 4 | 4 | 4 | 3 | 3 |
| Ad-mIFNg | 5 | 5 | 5 | 5 | 5 | 5 | 5 | 5 | 5 |
| Ad-mIL2 | 5 | 5 | 5 | 5 | 5 | 5 | 5 | 5 | 4 |
| Ad-mIFNb | 5 | 5 | 5 | 5 | 5 | 5 | 4 | 4 | 4 |

|                    | Number at risk |       |       |       |        |        |        |        |        |
|--------------------|----------------|-------|-------|-------|--------|--------|--------|--------|--------|
|                    | Day 1          | Day 3 | Day 5 | Day 7 | Day 10 | Day 13 | Day 15 | Day 17 | Day 20 |
| Ad5-Luc            | 6              | 6     | 6     | 6     | 6      | 6      | 5      | 5      | 4      |
| No injection + OT1 | 6              | 6     | 6     | 6     | 5      | 5      | 5      | 5      | 3      |
| Ad-mIL2            | 5              | 5     | 5     | 5     | 5      | 5      | 5      | 5      | 4      |
| Ad-mIL2 + OT1      | 5              | 5     | 5     | 5     | 4      | 4      | 4      | 4      | 4      |
| Ad5-Luc + OT1      | 5              | 5     | 5     | 5     | 5      | 5      | 5      | 4      | 4      |

A
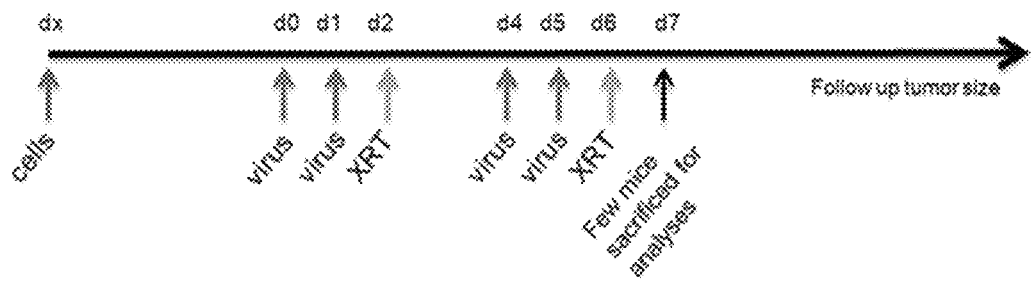
B
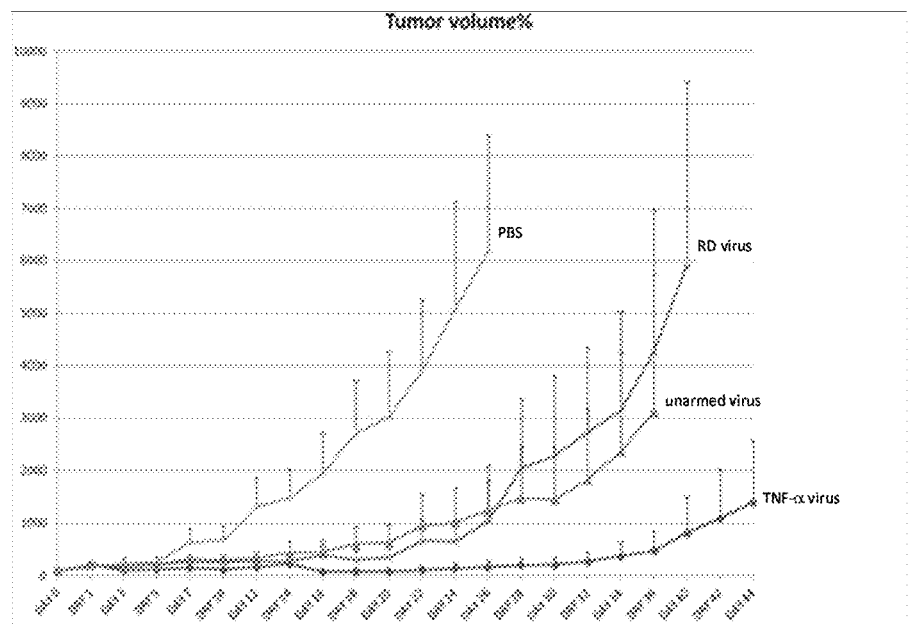
C
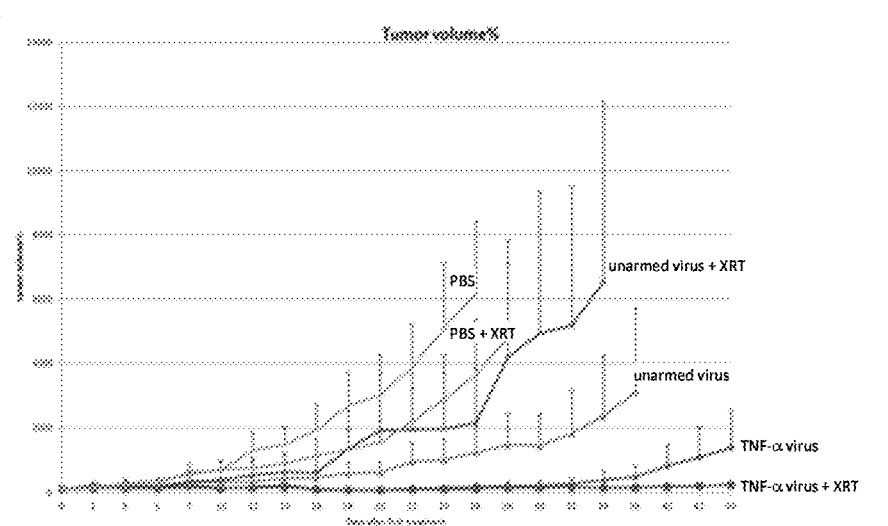
Figure 21.

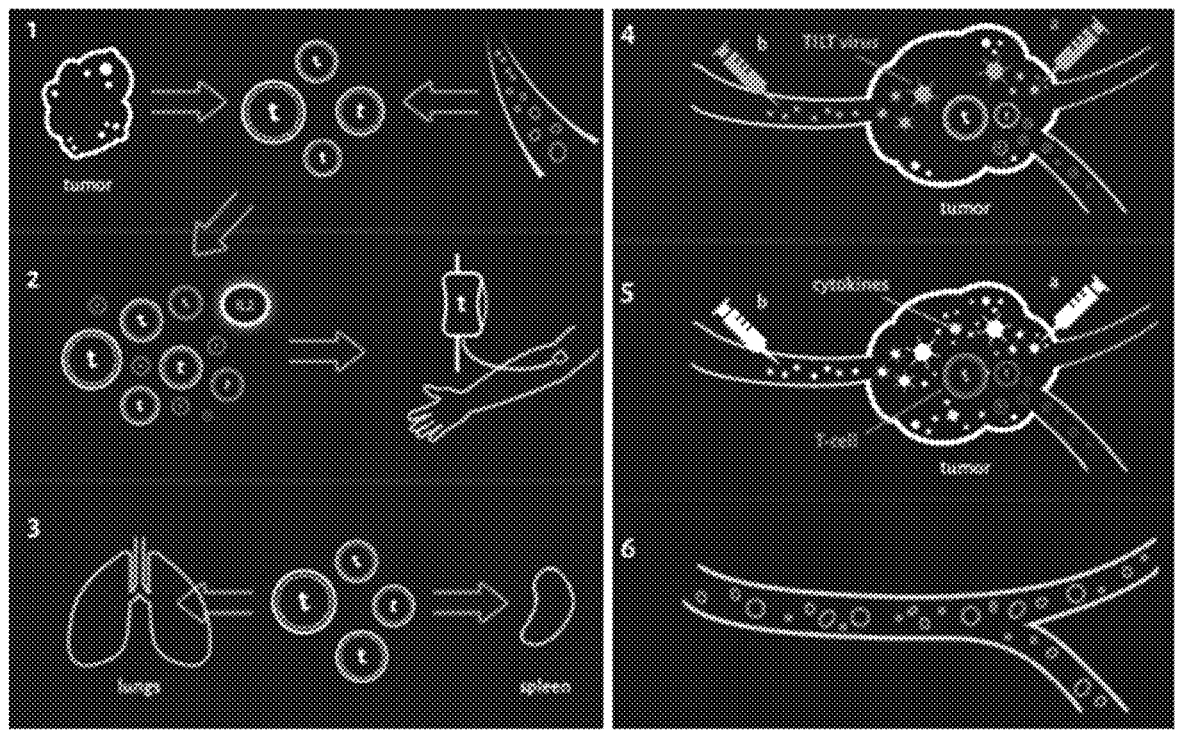
Figure 31.
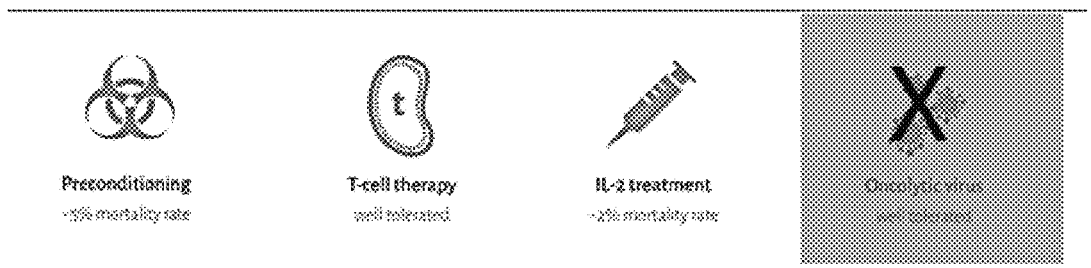
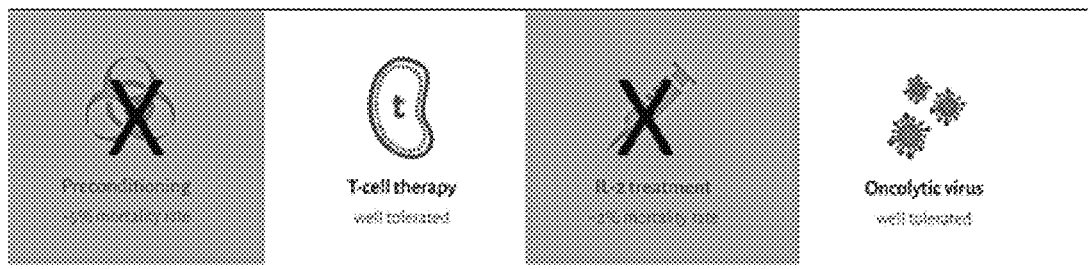
Figure 32.

'ribosome shunt site', 'ribosome skipping site', 'cis-acting hydrolase element' (CHYSEL), '2A-like':

Foot & mouth disease virus (FMDV) 2A peptide:

nucleotide sequence: gtgaaaCAGCTGTTGAATTTTGACCTTCTTAAGCTTGCGGGAGACGTCGAGTCCAACCCCGGGCCC translation: VKQLLNFDLLKLAGDVESNPG P

Porcine teshcovirus 1 (TV1) 2A peptide:

nucleotide sequence: ggcagcggcGCCACGAACTTCTCTCTGTTAAAGCAAGCAGGAGATGTTGAAGAAAACCCCGGGCCT translation: GSGATNFSLLKQAGDVEENPG P (The GSG spacer improves cleavage; Holst et al., 2006, Nat Prot)

Thosea asigna virus (TAV) 2A peptide:

nucleotide sequence: GAGGGCAGAGGAAGTCTTCTAACATGCGGTGACGTGGAGGAGAATCCCGGCCCT

EGRGSLLTCGDVEENPG P

Figure 35.

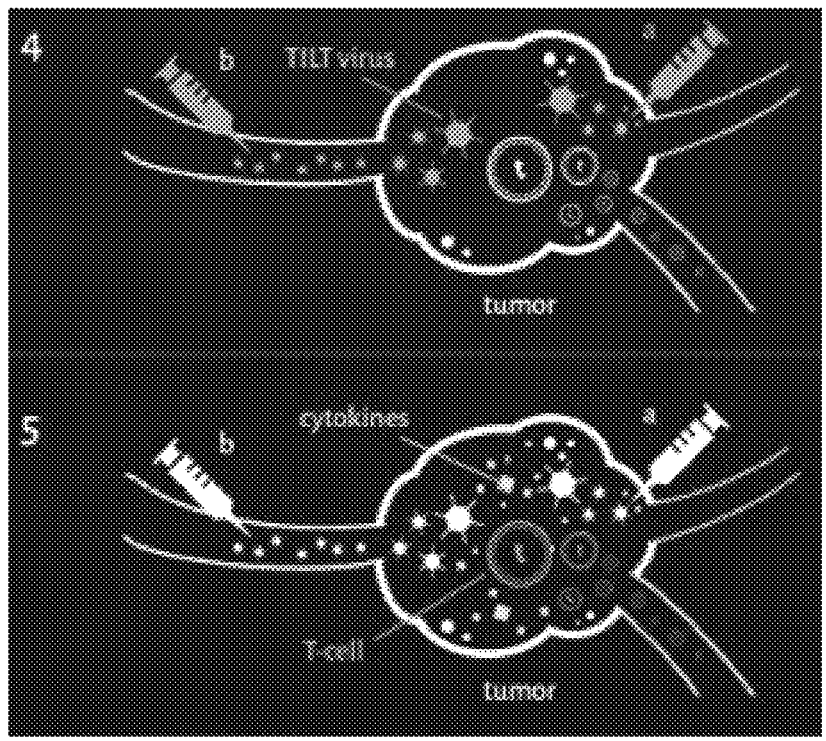

Figure 36.

hTERT promoter has replaced the native E1A promoter

Deletion of area 29892-30947 (Genbank accession no. DQ086466) affects the following features in the E3 unit:

E3 9-kDa, E3 10.2-kDa, E3 15.2-kDa, E3 15.3-kDa hTERT promoter has replaced the native E1A promoter Deletion of area 29892-30947 (Genbank accession no. DQ086466) affects the following features in the E3 unit:

E3 9-kDa, E3 10.2-kDa, E3 15.2-kDa, E3 15.3-kDa pWEA-Ad3-hTERT-CMV-CD40L

1. BamHI
2. BglI
3. BglII
4. NcoI
5. SacI
6. HindIII
7. EcoRI
8. FseI
9. uncut pWEA-Ad3-hTERT-E2F-CD40L 1. BamHI
2. BglI
3. BglII
4. NcoI
5. SacI
6. HindIII
7. EcoRI
8. FseI
9. uncut

ENHANCED ADOPTIVE CELL THERAPY

PRIORITY

This application claims priority of the Finnish national patent application number 20135387 filed on Apr. 18, 2013, the contents of which are incorporated herein by reference in entirety.

SEQUENCE LISTING

This patent application contains sequence listing, which is provided in electronic format and in portable document format. The contents of these submissions are identical.

FIELD OF THE INVENTION

The present invention relates to the fields of life sciences and medicine. Specifically, the invention relates to cancer therapies of humans. More specifically, the present invention relates to oncolytic adenoviral vectors alone or together with therapeutic compositions for therapeutic uses and therapeutic methods for cancer. In one aspect the present invention relates to separate administration of adoptive cell therapeutic composition and oncolytic adenoviral vectors. Furthermore, the present invention relates to a pharmaceutical kit and a pharmaceutical composition, both utilizing oncolytic adenoviral vectors.

BACKGROUND OF THE INVENTION

Novel therapies are constantly developed for cancer treatment. Adoptive cell therapies (ACT) are a potent approach for treating cancer but also for treating other diseases such as infections and graft versus host disease. Adoptive cell transfer is the passive transfer of ex vivo grown cells, most commonly immune-derived cells, into a host with the goal of transferring the immunologic functionality and characteristics of the transplant. Adoptive cell transfer can be autologous, as is common in adoptive T-cell therapies, or allogeneic as typical for treatment of infections or graft-versus-host disease. Clinically, common embodiments of this approach include transfer of either immune-promoting or tolerogenic cells such as lymphocytes to patients to either enhance immunity against viruses and cancer or to promote tolerance in the setting of autoimmune disease, such as type I diabetes or rheumatoid arthritis.

With regard to cancer therapy, the ACT approach was conceived in the 1980s by a small number of groups working in the US, one of the leading group being Steven Rosenberg and colleagues working at the NCI. The adoptive transfer of autologous tumor infiltrating lymphocytes (TILs) or genetically re-directed peripheral blood mononuclear cells has been used to successfully treat patients with advanced solid tumors such as melanoma as well as patients with CD19- expressing hematologic malignancies. In ACT, the most commonly used cell types are the T-cells, sometimes sorted for CD8+, but other variations include CD4+ cells, NK-cells, delta-gamma T-cells, regulatory T-cells and peripheral blood mononuclear cells. Cells can be unmodified such as in TIL therapy or genetically modified. There are two common ways to achieve genetic targeting of T-cells to tumor specific targets. One is transfer of a T-cell receptor with known specificity (TCR therapy) and with matched human leukocyte antigen (HLA, known as major histocompatibility complex in rodents) type. The other is modification of cells with artificial molecules such as chimeric antigen receptors (CAR). This approach is not dependent on HLA and is more flexible with regard to targeting molecules. For example, single chain antibodies can be used and CARs can also incorporate co-stimulatory domains. However, the targets of CAR cells need to be on the membrane of target cells, while TCR modifications can utilize intracellular targets.

For the first decade of ACT development, the focus was on TILs. TILs are found in tumors, suggesting that tumors trigger an immune response in the host. This so-called tumor immunogenicity is mediated by tumor antigens. These antigens distinguish the tumor from healthy cells, thereby providing an immunological stimulus.

For example, U.S. 2003194804 A1 describes a method for enhancing the reactivity of a T cell toward a tumor cell by utilizing TILs. In U.S. 2003194804 A1 the T cells are exposed to an agent and re-introducing into the patient. The agent is capable of reducing or preventing expression or interaction of an endogenous Notch or Notch ligand in the T cell.

U.S. Pat. No. 5,126,132 A describes a method of treating cancer, wherein an effective amount of autologous TILs and a cytokine are used.

Diaz R M et al. (Cancer Res. 2007 Mar. 15; 67(6):2840-8) describe an increase of the circulating levels of tumor antigen-specific T cells by using adoptive T cell transfer therapy in combination with vesicular stomatitis virus intratumoral virotherapy. Diaz et al. used OT1 cells i.e. an artificial monoclonal cell line in adoptive T cell transfer therapy.

While even in early trials of ACTs there were dramatic examples of treatment benefits, and even cures, most patients did not benefit and many patients experienced severe side effects. During the first two decades of adoptive cell therapy, safety of cell transfer per se was generally good, but significant toxicities and even mortality was associated with the concomitant treatments used to enhance the therapy, including preconditioning chemotherapy and radiation, and the IL-2 used after transfer. Preconditioning is used to kill suppressive cells such as regulatory T-cells and myeloid derived suppressors in the host, to modulate the tumor microenvironment and to "make room" for the graft. IL2 is used post-transfer to reduce anergy of the graft and to propagate it.

With regard to efficacy, room is left for improvement. Increased specificity and sufficient tumor killing ability of cell therapies in general are warranted. In particular, in the ACT of the prior art the transferred cells fail to traffic to tumors, and even if they do, they often quickly become anergic, are otherwise unable to kill tumor cells or fail to propagate resulting in a rapid decline of cell numbers. Furthermore, cancers frequently down-regulate human leukocyte antigen (HLA)—known as major histocompatibility complex in animals—in tumor cells, thus resulting in inability of T-cells to kill, as HLA is required for presentation of tumor epitopes to the T-cell receptor.

The present invention provides efficient tools and methods for cancer therapeutics utilizing adoptive cell transfers.

BRIEF DESCRIPTION OF THE INVENTION

An object of the present invention is to provide simple methods and tools for overcoming the above problems of inefficient, unsafe and unpredictable cancer therapies. More specifically, the invention provides novel methods and means for cell therapy. The objects of the invention are achieved by viral vectors, methods and arrangements, which are characterized by what is stated in the independent claims. The specific embodiments of the invention are disclosed in the dependent claims.

The present application describes construction of recombinant viral vectors, methods related to the viral vectors, and their use in tumor cells lines, animal models and cancer patients.

The invention is based on the idea of combining oncolytic adenoviral vectors coding for cytokines or adenoviral vectors with adoptive cell therapeutics for cancer treatment in a novel and inventive way. The invention is based on surprising effects, i.e. the following improvements in adoptive T-cell therapy: i) recruitment of transferred cells to the tumor, ii) propagation of transferred cells at the tumor, iii) enhanced reactivity of transferred cells at the tumor (FIG. 20). Indeed, the said combination of viral vectors and cytokines with adoptive cell therapeutics provides more effective results on wider targets than could have been assumed. Effects of the said combination of viral vectors comprising cytokine transgene with adoptive cell transfer are synergistic compared to the effects of only viral vectors comprising cytokine transgene or only adoptive cell transfers.

It is a further object of the present invention to provide a combination of tumor infiltrating lymphocytes (TIL) and transgenic (produced from a virally delivered transgene) interleukin-2 (IL-2) for the treatment of malignancy in humans. The above and various other objects and advantages of the present invention are achieved by a method of treating malignancy in humans, comprising administering an effective amount of TIL and IL-2, with or without preconditioning chemotherapy and/or radiotherapy, to a patient afflicted with cancer to cause regression or stabilization of the cancer.

The present invention relates to a method of treating cancer in a subject, wherein the method comprises separate administration of adoptive cell therapeutic composition and oncolytic (=replication competent in tumor but not normal cells) adenoviral vectors coding for at least one cytokine to a subject.

The present invention further relates to an oncolytic adenoviral vector coding for at least one cytokine together with separate adoptive cell therapeutic composition for use in treatment of cancer.

The present invention further relates to a use of an oncolytic adenoviral vector coding for at least one cytokine together with separate adoptive cell therapeutic composition in the manufacture of a medicament for treating cancer in a subject.

The present invention also relates to an oncolytic adenoviral vector for use in increasing the efficacy of adoptive cell therapy or T-cell therapy in a subject.

Also, the present invention relates to a use of an oncolytic adenoviral vector in the manufacture of a medicament for increasing the efficacy of T-cell therapy in a subject.

Also, the present invention relates to a method of increasing the efficacy of adoptive cell therapy or T-cell therapy in a subject by administering an oncolytic adenoviral vector to a subject in need thereof.

The present invention also relates to a pharmaceutical kit comprising an adoptive cell therapeutic composition and oncolytic adenoviral vectors coding for at least one cytokine, wherein the adoptive cell therapeutic composition is formulated in a first formulation and the oncolytic adenoviral vectors coding for at least one cytokine are formulated in a second formulation.

Furthermore, the present invention relates to an oncolytic adenoviral vector comprising 1) an adenovirus serotype 5 (Ad5) nucleic acid backbone comprising a 5/3 chimeric fiber knob:
2) E2F1 promoter for tumor specific expression of E1A;
3) a 24 bp deletion (D24) in the Rb binding constant region 2 of adenoviral E1;
4) a nucleic acid sequence deletion of viral gp19 k and 6.7 k reading frames; and
5) a nucleic acid sequence encoding at least one cytokine transgene in the place of the deleted gp19 k/6.7 K in the E3 region resulting in replication-associated control of transgene expression under the viral E3 promoter, wherein the cytokine is selected from a group consisting of interferon alpha, interferon beta, interferon gamma, complement C5a, IL-2, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5 (=RANTES), CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2.

Furthermore, the present invention relates to a serotype 3 (Ad3) oncolytic adenoviral vector comprising: a deletion in the E3 area and a tumor specific promoter for expression of a transgene in the place of the deleted area of E3.

Still, the present invention relates to a pharmaceutical composition comprising an oncolytic vector of the invention.

Also, the present invention relates to a method of treating cancer in a subject, wherein the method comprises administration of the oncolytic adenoviral vector of the present invention to a subject in need thereof. Also, the present invention relates to an oncolytic adenoviral vector of the present invention for use in treatment of cancer.

Also, the present invention relates to a use of an oncolytic adenoviral vector of the present invention in the manufacture of a medicament for treating cancer in a subject.

The advantages of the arrangements of the present invention are enhanced therapeutic effect and reduced side effects. Severe adverse events, even deaths are prevented, because enhancements in efficacy, and the anti-suppressive effects of our approach, may reduce the need for preconditioning chemotherapy and/or radiation used in the prior art methods to "make room" for transferred cells and reduce tumor immunosuppression. Also, severe adverse events, even deaths are prevented, because separate addition of IL2 used in the prior art methods to propagate and sustain transferred cells after transferring them into a patient is not needed if the virus produces it while replicating in the tumor. Local production at the tumor can also enhance the sought-after effects of IL-2 (stimulation and propagation of the graft) while reducing systemic exposure which is the cause of adverse events. The present invention provides selective treatments, with less toxicity or damage to healthy tissues.

Also, the present invention provides surprising therapeutic effects by: i) Providing trafficking signals to the tumor for example by injecting the virus vectors comprising recombinant cytokines into tumor. Virus injection results in production of cytokines relevant for this effect (in reaction to the virus binding to pathogen associated molecular pattern recognition receptors), but much higher effects can be achieved by additional production of the most relevant cytokine as a transgene from the virus. ii) Reducing tolerance by increasing danger signals. Virus injection per se can achieve this by binding to pathogen associated molecular pattern recognition receptors, but the effect can be enhanced by additional production of a cytokine as a transgene from the virus. iii) Inducing HLA expression. Virus infection increases HLA expression, since cells attempt to present viral epitopes for mounting an anti-viral T-cell response. Unexpectedly, this can be used to enhance T-cell therapy against tumor epitopes, which requires HLA to work. The effect of the virus on HLA is mediated in part by cytokines; production of said cytokine from the virus can thus induce HLA expression also in nearby tumor cells in a surprising embodiment of the invention. iv) Inducing propagation of cells by lifting immunosuppression, mediated by both the presence of the virus per se (again through the pathogen associated molecular pattern recognition receptors), but enhanced by production of cytokines (FIG. 4B). Thus, this approach can solve the critical obstacles currently hindering adaptive cell therapies.

BRIEF DESCRIPTION OF THE DRAWINGS

In the following the invention will be described in greater detail by means of specific embodiments with reference to the attached drawings, in which

FIG. 6 shows results of adenovirus injections combined with adoptive transfer of T cells. Mice with subcutaneous B16-Ova tumors were adoptively transferred with 5×10$^5$ OT1 lymphocytes intraperitoneally and tumors were left untreated, or injected with PBS or Ad5/3 (see Examples Materials and methods). In an immunosuppressive B16-Ova model similar to human melanoma, adoptive transfer of anti-Ova OT1 cells does little. Adding virus injections increases efficacy dramatically (a). CD8+ T-cells increase (b). These cells are not anti-Ova T-cells (c).

FIG. 9 shows that increase in anti-tumor T-cells and reduction of immunosuppression results in systemic immunity against tumor antigens. Mice with subcutaneous B16-Ova tumors were adoptively transferred with 5×10$^5$ OT1 (a) or 2×10$^6$ (b) OT1 lymphocytes intraperitoneally and tumors were left untreated, or injected with PBS or Ad5/3 (see Examples Materials and methods). Antigen presentation is enhanced by virus: T-cells work better. Systemic immunity against several tumor epitopes results. (a) expression of co-stimulatory molecules on dendritic cells (CD11c+CD80+ CD86+) in the tumor on day 14. (b) IFNg ELISPOT with splenocytes on day 14.

FIG. 10 shows distribution of OTI T-cells following virus injection: trend for trafficking but not enough to explain efficacy. (a) diagram, (b) animal model, (c) tumor.

T-cells interaperitoneally on Day 1. Cytokine-coding adenoviruses or control virus Ad5-Luc1 were injected intratumorally on Day 1 and weekly thereafter (1×10e9 viral particles per tumor). Tumor volume was calculated as previously described (Bramante et al. Serotype chimeric oncolytic adenovirus coding for GM-CSF for treatment of sarcoma in rodents and humans. Int J Cancer. 2013 Dec. 24) and tumor sizes are indicated as percentage respective to Day 1, which was set as 100%. Number at risk figure: Number of animals remaining in each experimental group at a given timepoint. Animals were humanely sacrificed when the tumors had exceeded the maximum acceptable size or when any signs of pain or distress were evident.

Figure 14:
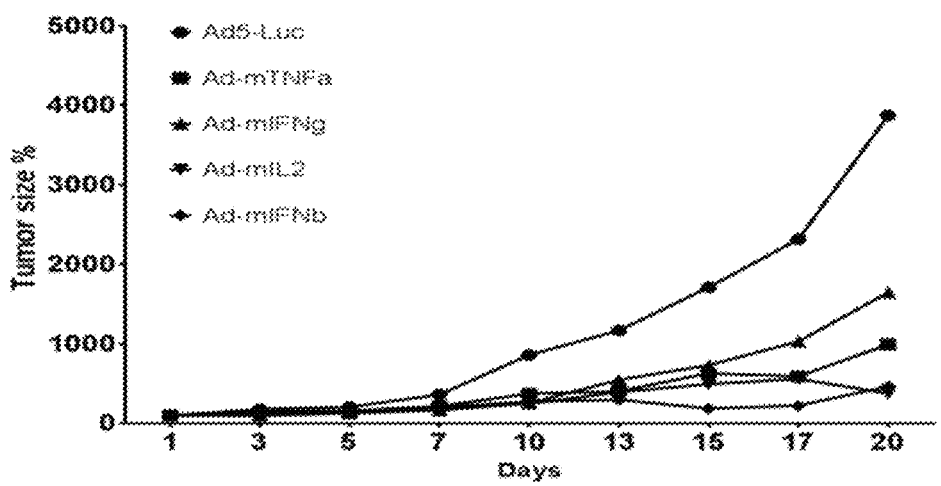

FIG. 14 shows effects of different viruses on tumor size.

Figure 15:
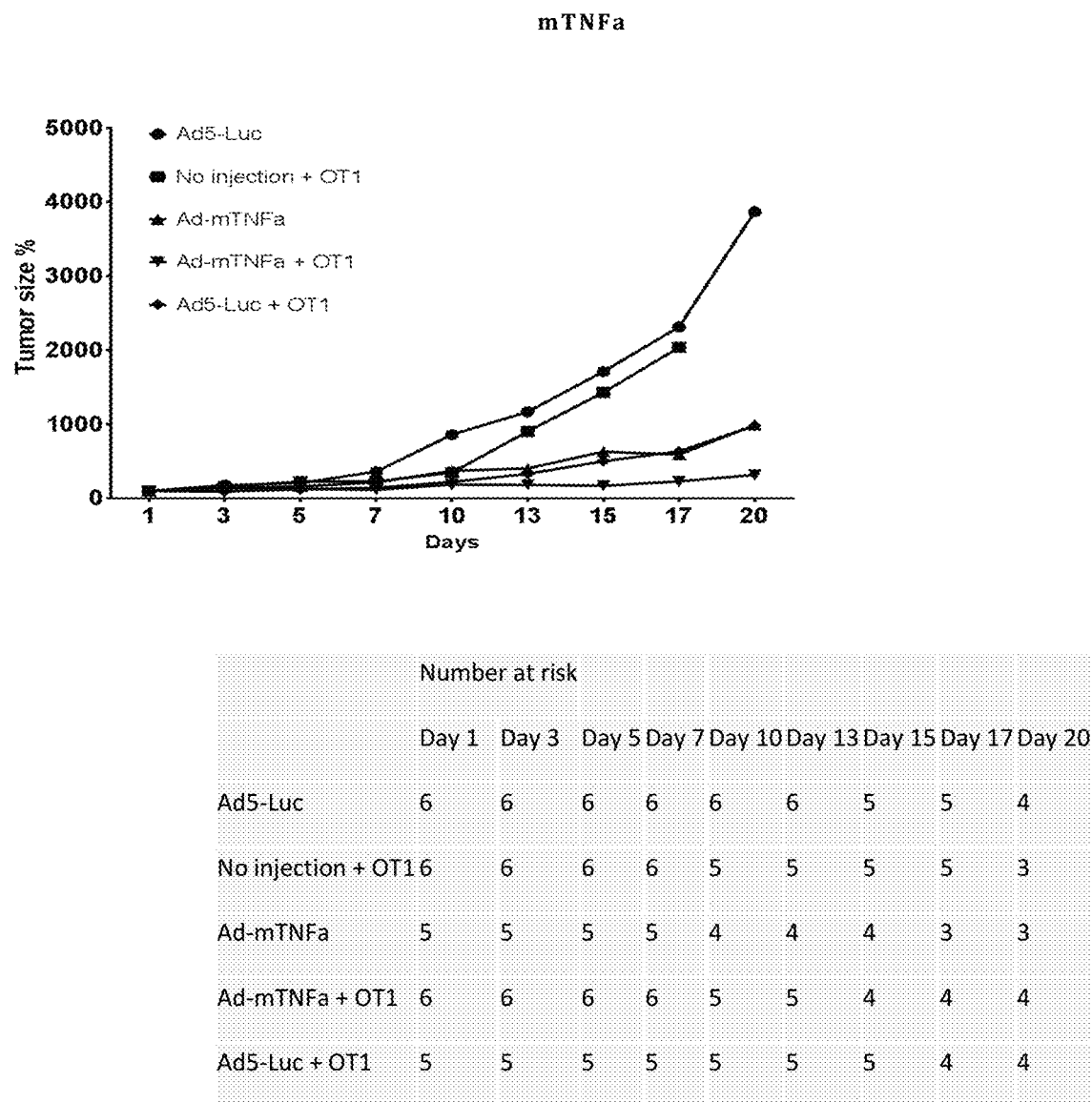

FIG. 15 shows excellent results of adenoviral vectors comprising mTNFa transgene in combination with OT1 T-cells on reducing the tumor size.

Figure 16:
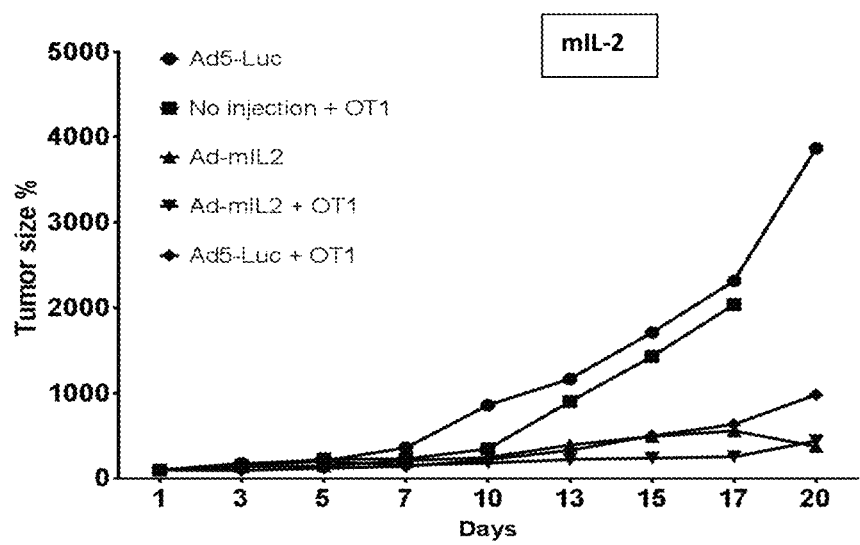

FIG. 16 shows excellent results of adenoviral vectors comprising mIL3 transgene in combination with OT1 T-cells on reducing the tumor size.

Figure 17:
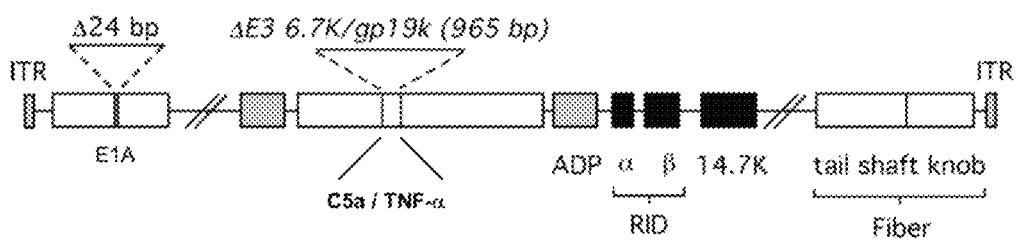

FIG. 17 shows a schematic of C5a or TNF-α expressing oncolytic adenoviruses. Shown are some important features of the viruses, including the site where the transgenes are inserted.

Figure 18:
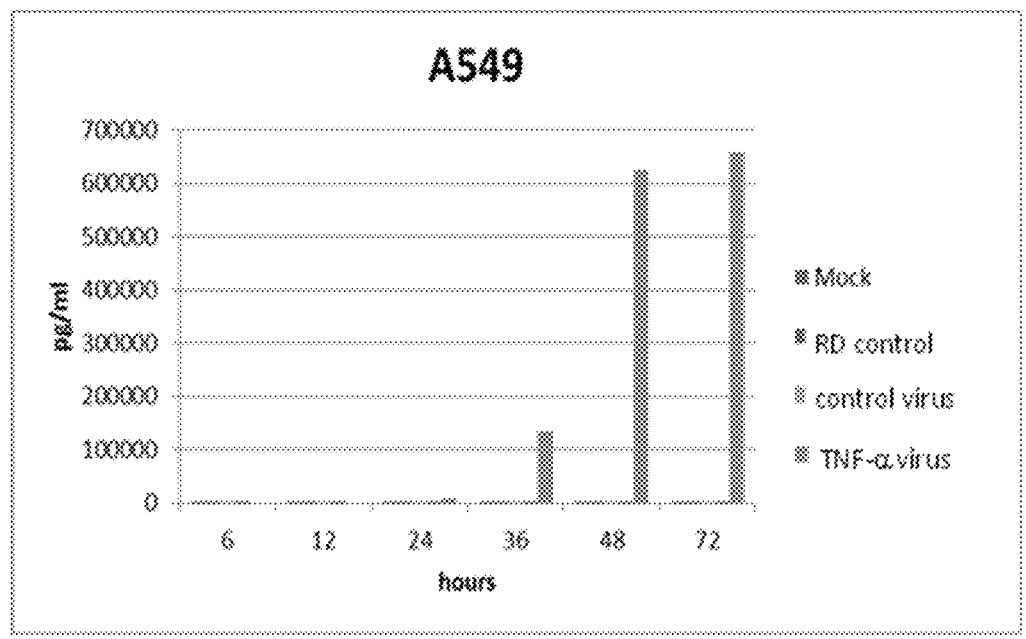

FIG. 18 shows expression of TNF-α by oncolytic adenovirus in A549 cells. Cells were infected with 10 VP/cell, media was collected at indicated time points and ELISA was used to assess the amount of TNF-α in the media. Virus induces expression and secretion of TNF-α from infected cells.

Figure 19:
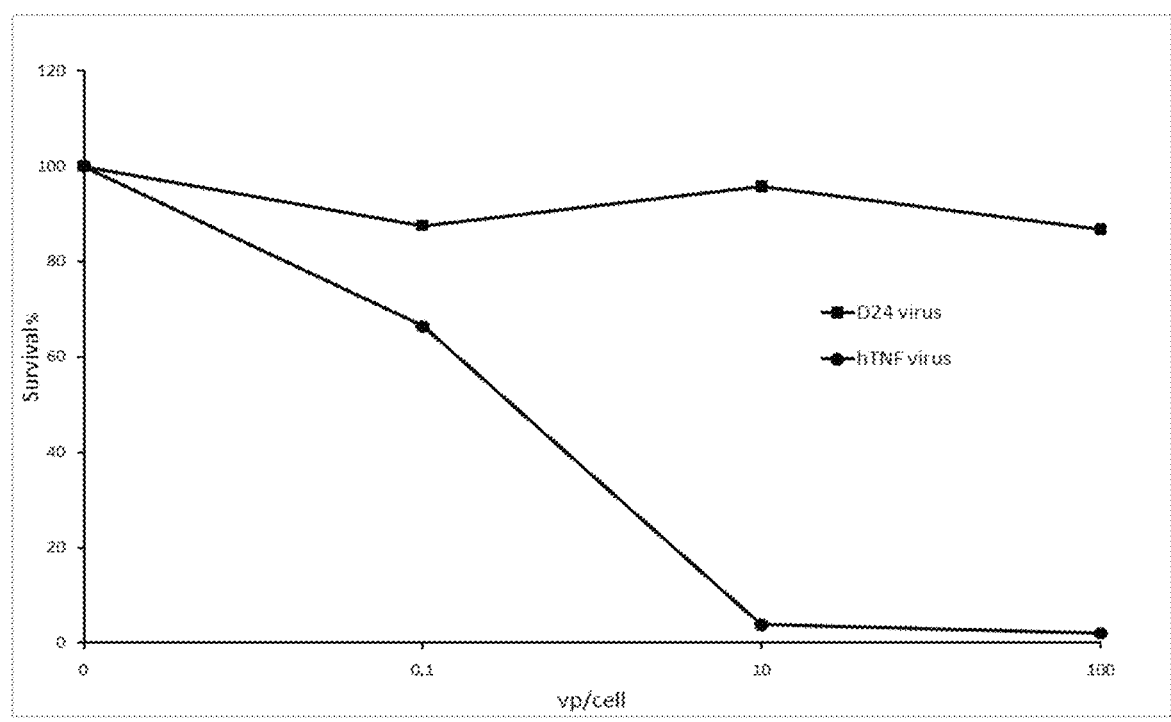

FIG. 19 shows biological activity of TNF-alpha produced by oncolytic TNF-alpha-armed oncolytic adenovirus. In this assay, supernatant from infected cells was used to challenge TNF-sensitive WEHI-13VAR cells, corroborating that oncolytic adenovirus drives expression of functional cytokines.

Figure 20:
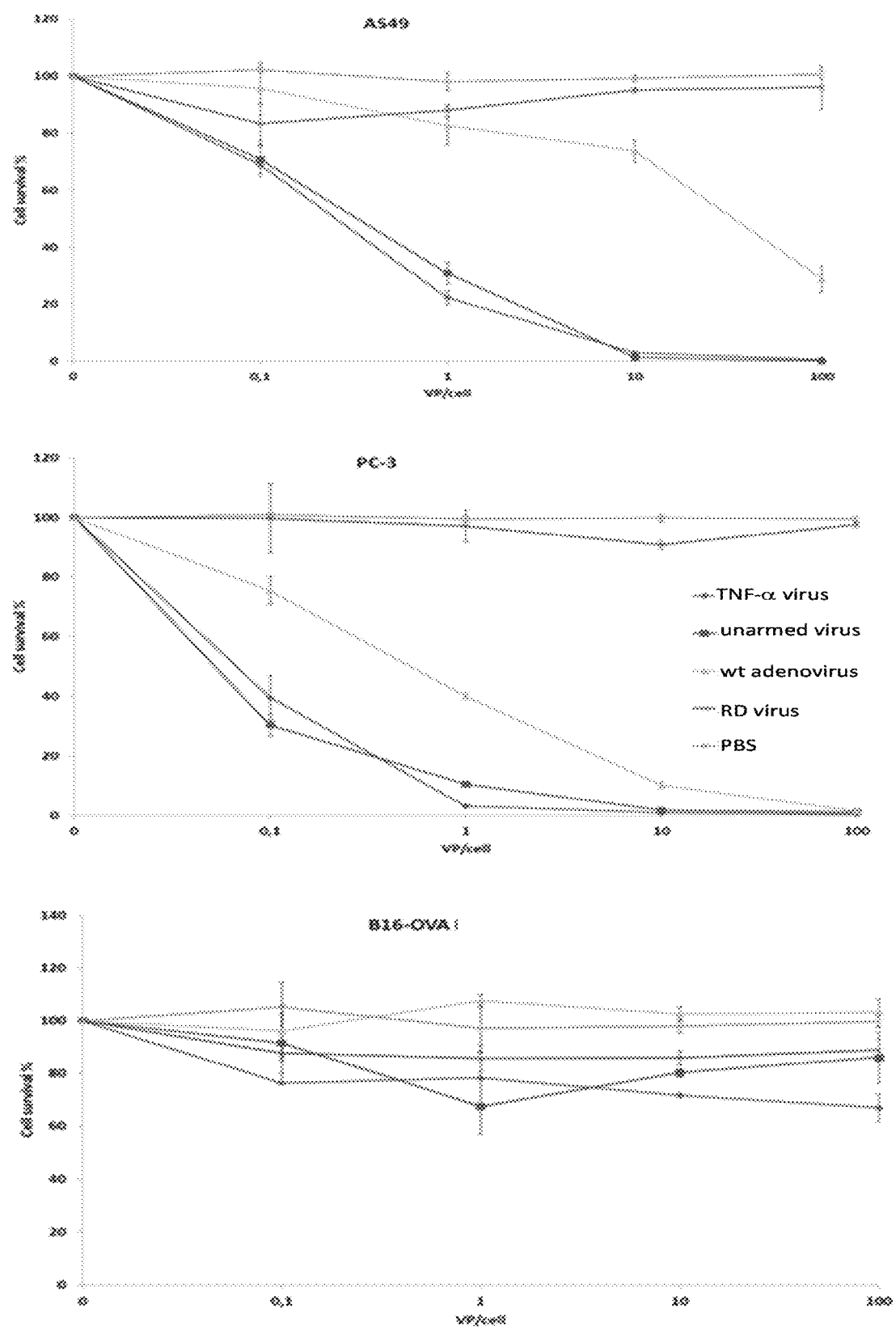

FIG. 20 shows dose-dependent killing of human cancer cells by oncolytic adenovirus. As expected, in TNF-alpha insensitive oncolysis permissive human A549 or PC3 tumor cells, no difference was observed between unarmed control virus and TNF-alpha-expressing oncolytic adenovirus, as mere oncolysis was sufficient to kill cells. However, because human TNF-alpha is partially active in mouse cells, which are not permissive to oncolysis by human adenovirus, TNF-alpha contributed to the stronger cytotoxicity of the virus seen in B16-OVA mouse cells compared to unarmed virus. Replication-defective virus shows negligible cell-killing capacity.

FIG. 21 shows that radiation therapy synergizes with TNF-alpha expressing virus. A) A schematic of the treatment schedule in this experiment. Radiation (XRT) was whole body irradiation at a dose of 2×2Gy and virus was $1×10^8$ VP/tumor, where each nude mouse carried two A549 xenografts. B) TNF-alpha virus harbors greater anti-tumor potency than the unarmed parental virus. Because replication-defective (RD) virus did not kill A549 cells in culture (FIG. 20), the anti-tumor effect afforded by RD virus in vivo is likely due to innate immune responses, including cytokines, NK cells and macrophages, elicited by virus injections. C) TNF-alpha-expressing virus causes greater anti-tumor effects when combined with clinically relevant doses of external beam irradiation, supporting the clinical translatability of cytokine-armed viruses. Importantly, these and previous experiments indicate that TNF-alpha-expressing oncolytic adenovirus is capable of replicating and killing cells, arguing that TNF-alpha does not exert antiviral effects against adenovirus.

Figure 22:
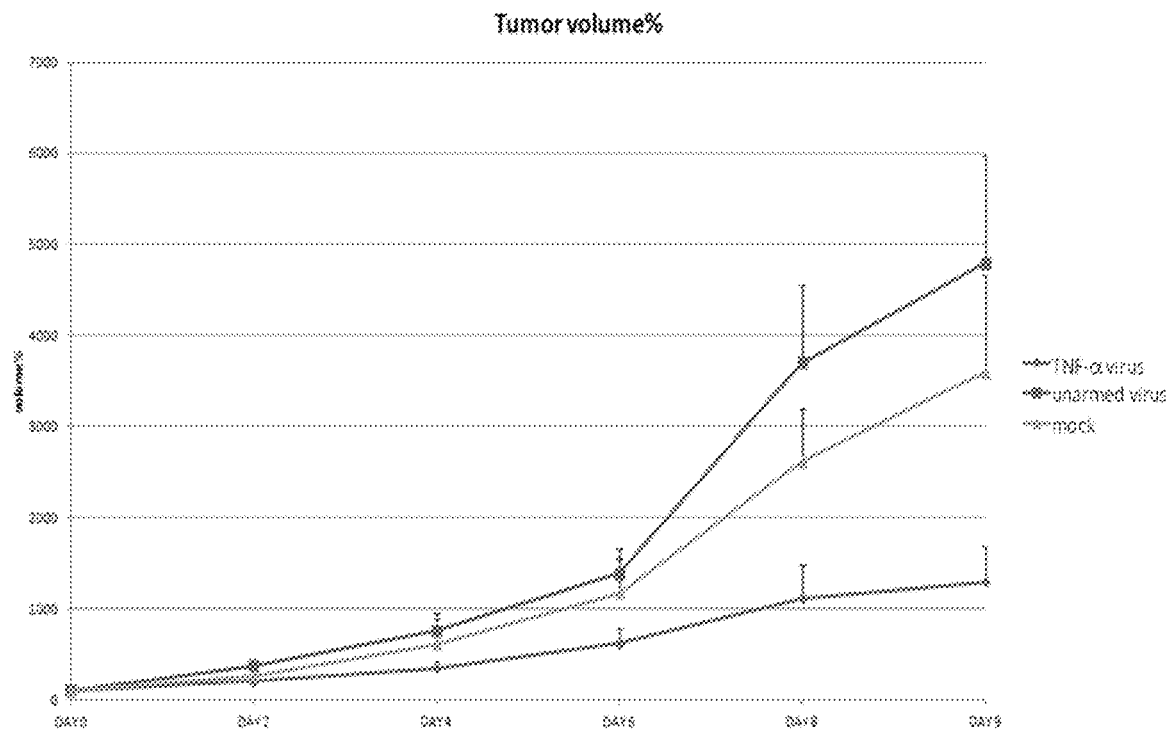

FIG. 22 shows anti-tumor efficacy of hTNF-alpha-encoding adenovirus on B16-OVA tumors. This experiment is analogous to the one depicted in FIG. 26 with C5a virus, demonstrating that TNF-alpha-expression confers greater therapeutic advantage compared to unarmed virus.

Figure 23:
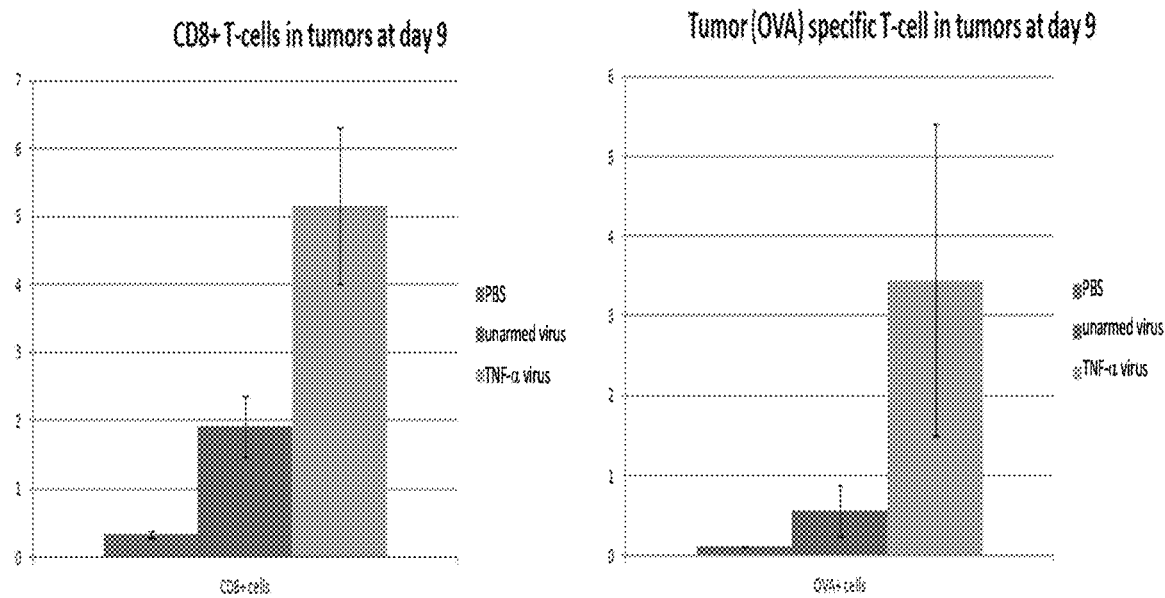

FIG. 23 shows enhanced induction/expansion of tumor-specific CD8+ T cells in tumors treated with cytokine armed virus (II). Tumors in the experiment depicted in FIG. 20 were excised and processed for flow cytometric analysis, similar to as in Experiment 11. A greater induction/number of OVA-specific CD8+ T cells was detected in tumors treated with the TNF-encoding virus compared to unarmed control virus, suggesting together with C5a data that rationally selected cytokines expressed by oncolytic adenovirus together with the virus-induced inflammation make a unique tumor milieu that strongly supports expansion and activation of tumor-specific T cells—by inferral and comparison to FIGS. 2B,C also of adoptively transferred T cells.

Figure 24:
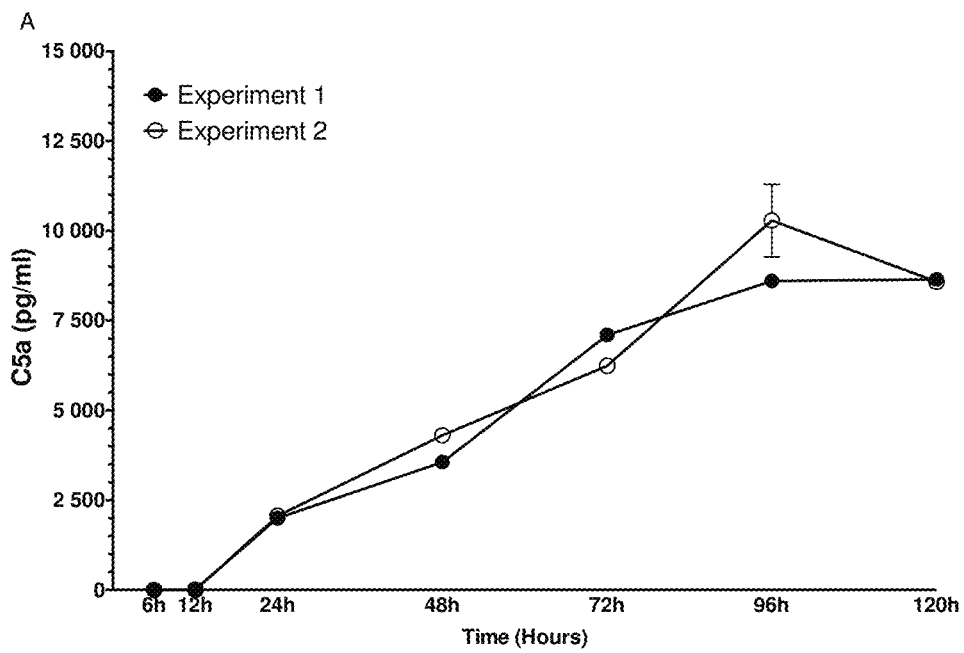

FIG. 24 shows expression of C5a in A549 cells. Cells were infected with 10 VP/cell, media was collected at indicated time points and ELISA was used to assess the amount of C5a in the media. Results of two individual experiments are shown.

Figure 25:
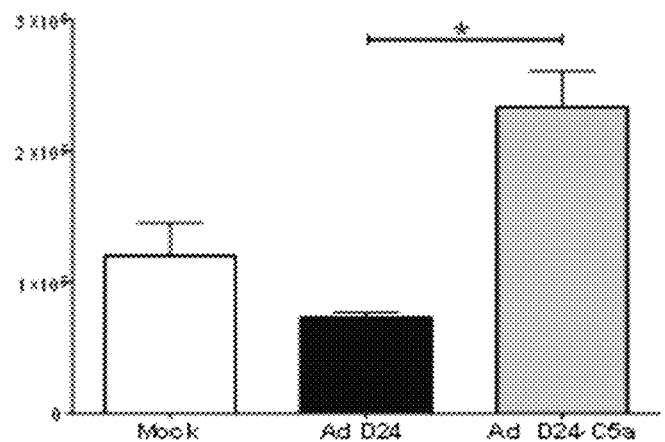

FIG. 25 shows results of an in vitro chemotaxis assay. The amount of THP1 human monocytes passing through a semi-permeable membrane into the lower chamber, as attracted by chemokines in the test supernatants, was quantified as per manufacturer's instructions (Millipore QCM kit). C5a-expressing virus elicits stronger chemoattractive factors from infected cells than control virus. Results argue in favor of using cytokine-armed virus rather than unarmed virus.

Figure 26:
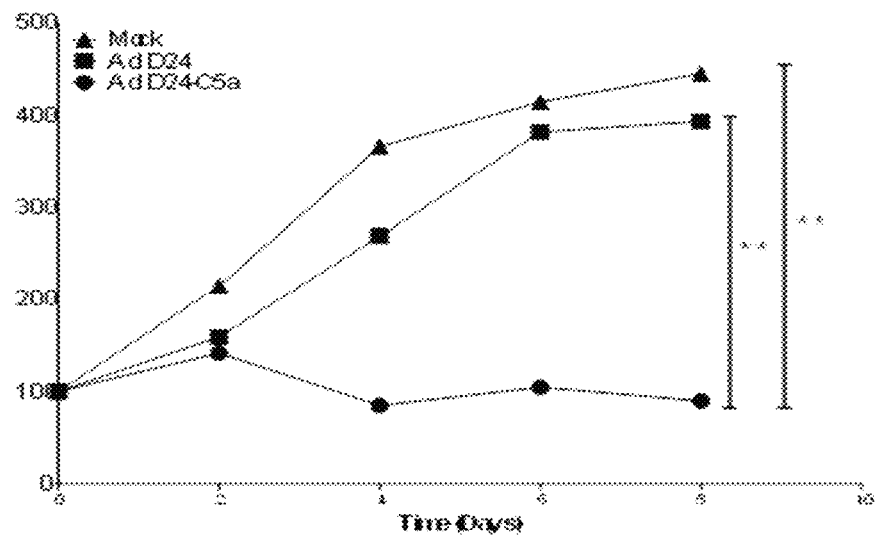

FIG. 26 shows anti-tumor efficacy of AdD24-C5a in vivo. Established subcutaneous tumors were injected on day 0, 2 and 4 with $1×10^9$ VP of each virus or with 50 ul PBS and tumor volumes were measured by caliper. C5a-expressing virus affords superior tumor control compared to control virus. As adenovirus does not replicate in or kill mouse cells, i.e. it is non-cytolytic in this model (Young A M et al. Mol Ther. 2012 September; 20(9):1676-88, PMID: 22735379), these results underscore the robust ability of the cytokine-armed virus to enhance immunological anti-tumor effects, strongly supporting the concept of using it to enhance efficacy of adoptive cell therapy.

Figure 27:
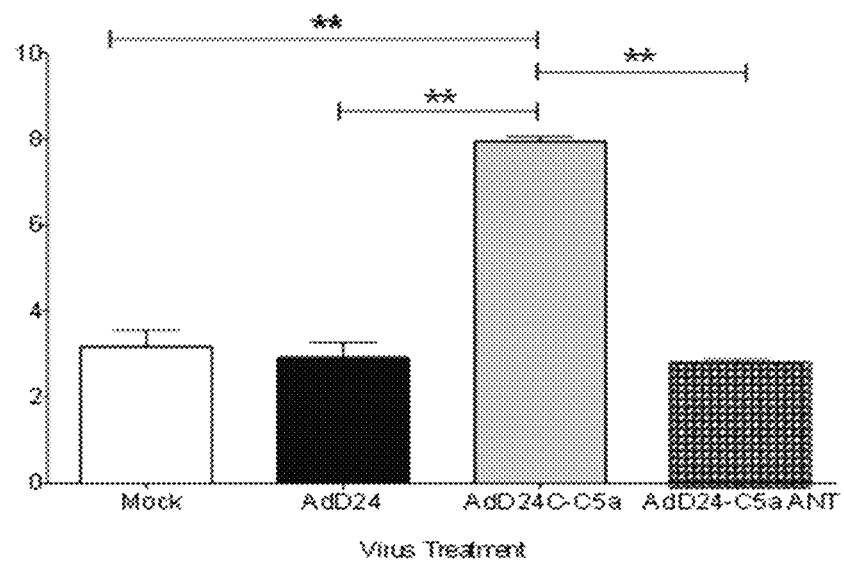

FIG. 27 shows enhanced induction/expansion of tumor-specific CD8+ T cells in tumors treated with cytokine armed virus (I). Tumors in experiment depicted in FIG. 26 were excised and processed for flow cytometric analysis. Single cell suspensions were stained with antibody against CD8 and with pentamer against anti-ova TCR. C5a-expression by non-cytolytic adenovirus induces greater OVA-specific CD8 T cell numbers in tumors compared to control viruses, unarmed adenovirus or virus expressing C5a antagonist, supporting the use of cytokine-armed virus to increase numbers of adoptively transferred T cells in tumors. Also see experiment 13.

Figure 28:
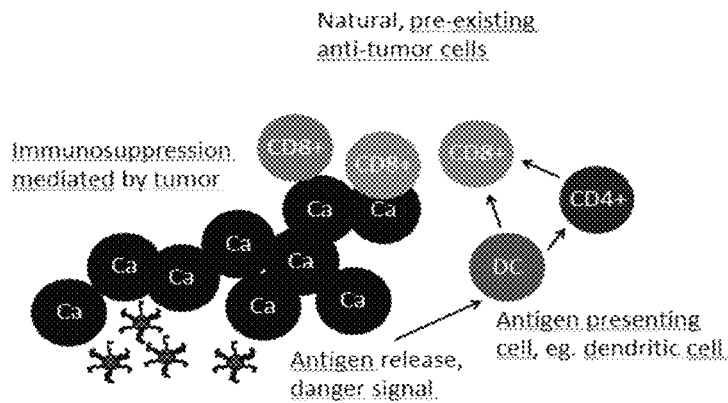

FIG. 28 shows a schematic of the adaptive T-cell response.

Figure 29:
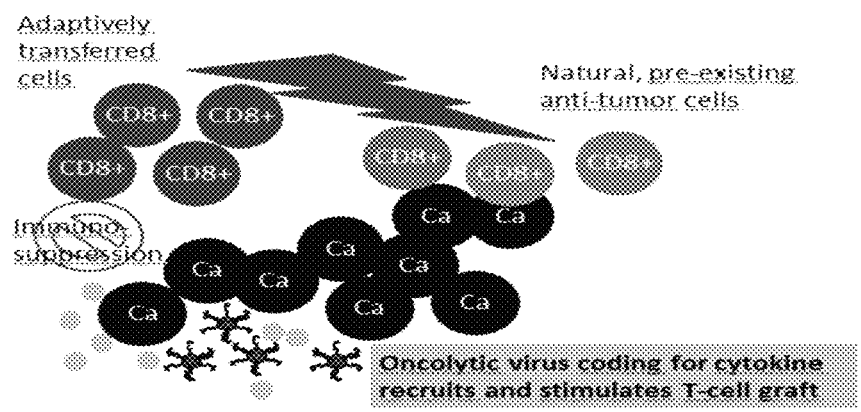

FIG. 29 shows that adaptively transferred T-cells act as a catalyst ("spark") for preexisting T-cells.

Figure 30:
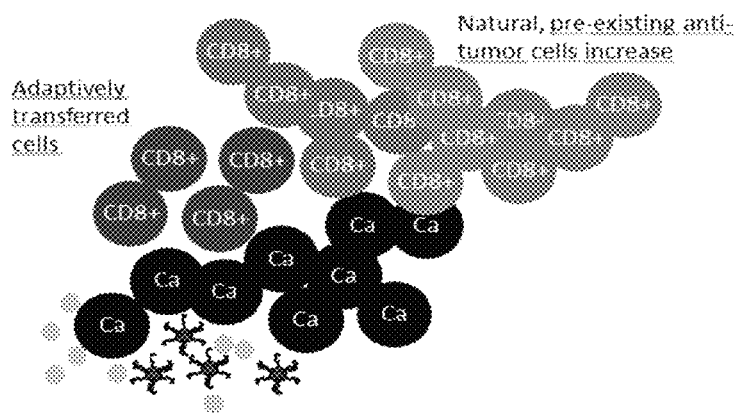

FIG. 30 shows that adaptive "spark" results in increase in "natural" anti-tumor T-cells.

FIG. 31 shows the method of adoptive cell transfer.

FIG. 32 shows that with TILT technology of the present invention, toxic preconditioning (chemo+radiation) and post-conditioning (systemic IL2) can be avoided. (For mechanisms of TILT technology see FIG. 48.)

Figure 33:
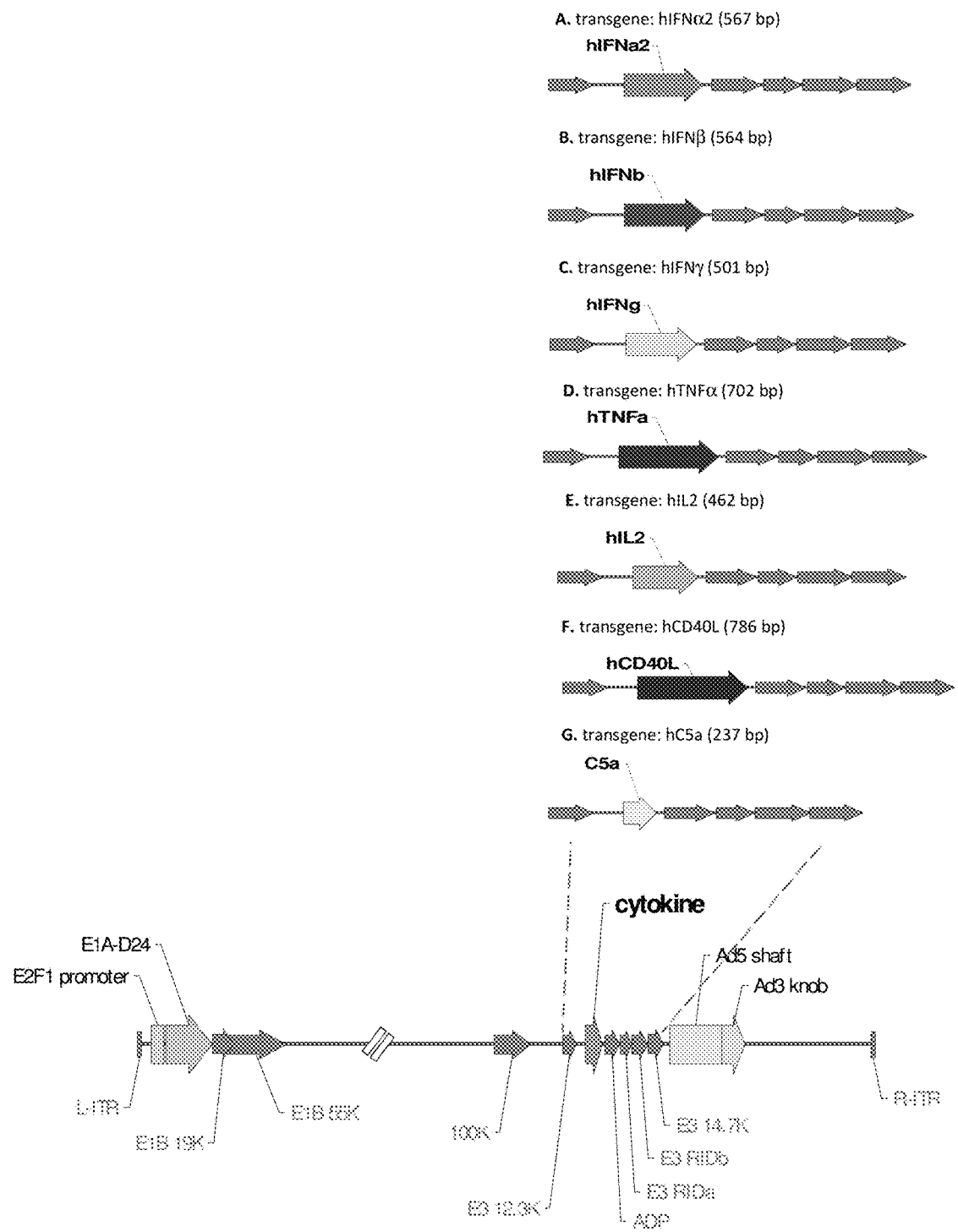

FIG. 33 shows a schematic of the new virus constructs expressing a single cytokine. The virus backbone is human adenovirus serotype 5, apart from the fiber knob, which is from serotype 3. Both single and double transgenes are under transcriptional control of the virus E3 promoter. Both transgenes are placed into the E3 region which is deleted for gp19 k and 6.7 k. The E1A protein is deleted for 24 amino acids ("D24"), in constant region 2, rendering Rb binding defective. E1A expression is under regulation of the E2F promoter. Some virus gene regions are shown for reference.

Figure 34:
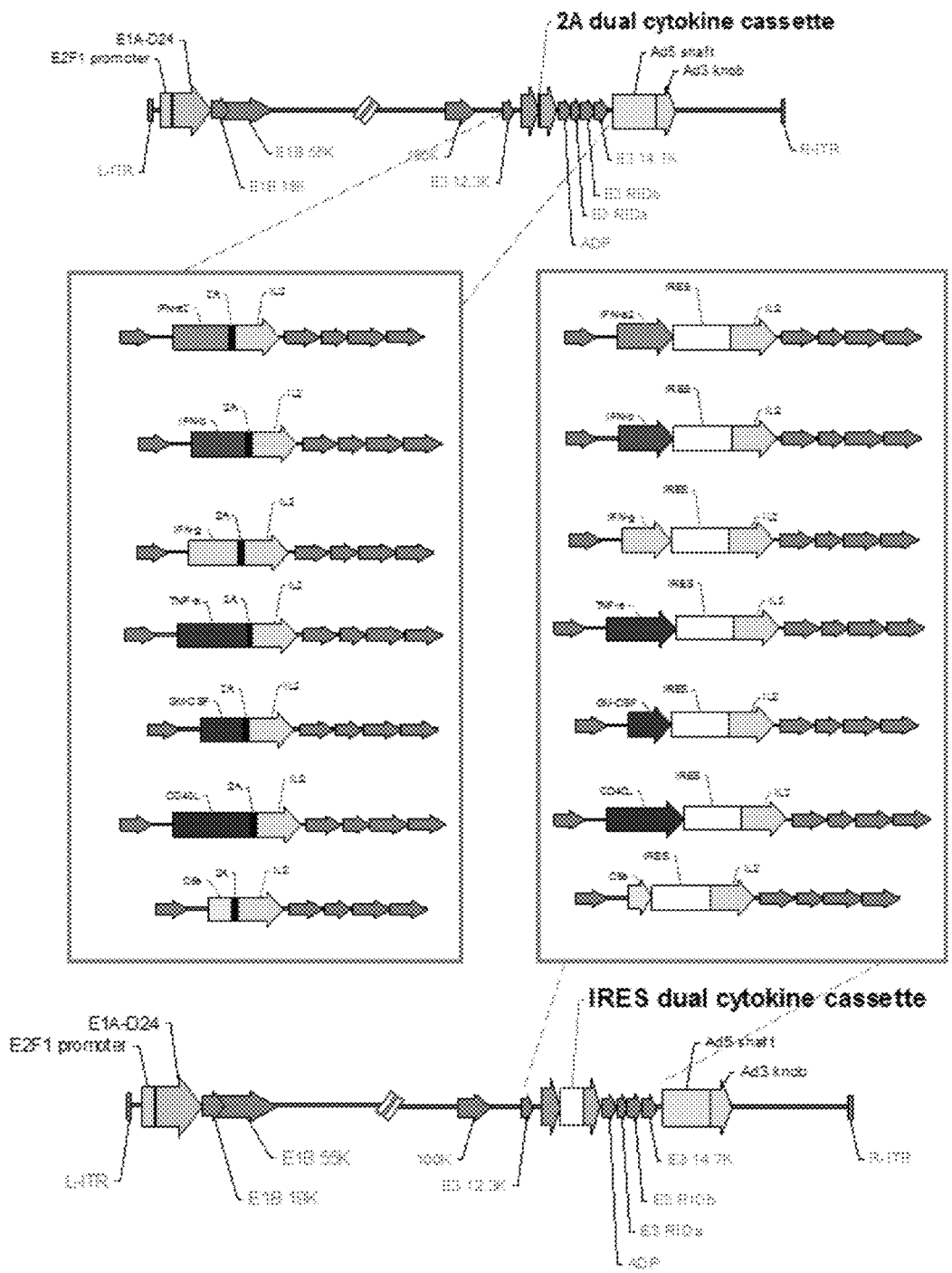

FIG. 34 shows a schematic of the new virus constructs expressing two cytokines. In one version, 'ribosome shunt site'/'ribosome skipping site'/'cis-acting hydrolase element' (CHYSEL) is placed as in-frame fusions between each cytokine. The cytokine inserts will be synthesized as a single polyprotein that is co-translationally cleaved to yield both cytokines, resulting in addition of several additional amino acids at the 3' end of the first cytokine, and a single proline at the 5' of the latter cytokine, IL2). In another version, an IRES element separates the two cytokines, resulting in synthesis of cytokines with no additional amino acids.

FIG. 35 shows nucleotide and amino acid sequences of 2A.

FIG. 36 shows TILT Biotherapeutics intravenous adenovirus delivery technology. TILT adenoviruses descibed above will be given intratumorally to patients to enhance T-cell therapy (marked 4a, 5a). However, not all tumors can be reached through the intratumoral route. Thus, we have developed an Ad3 based delivery vehicle which can reach tumors through the intravenous route (marked as 4b, 5b).

Figure 37:
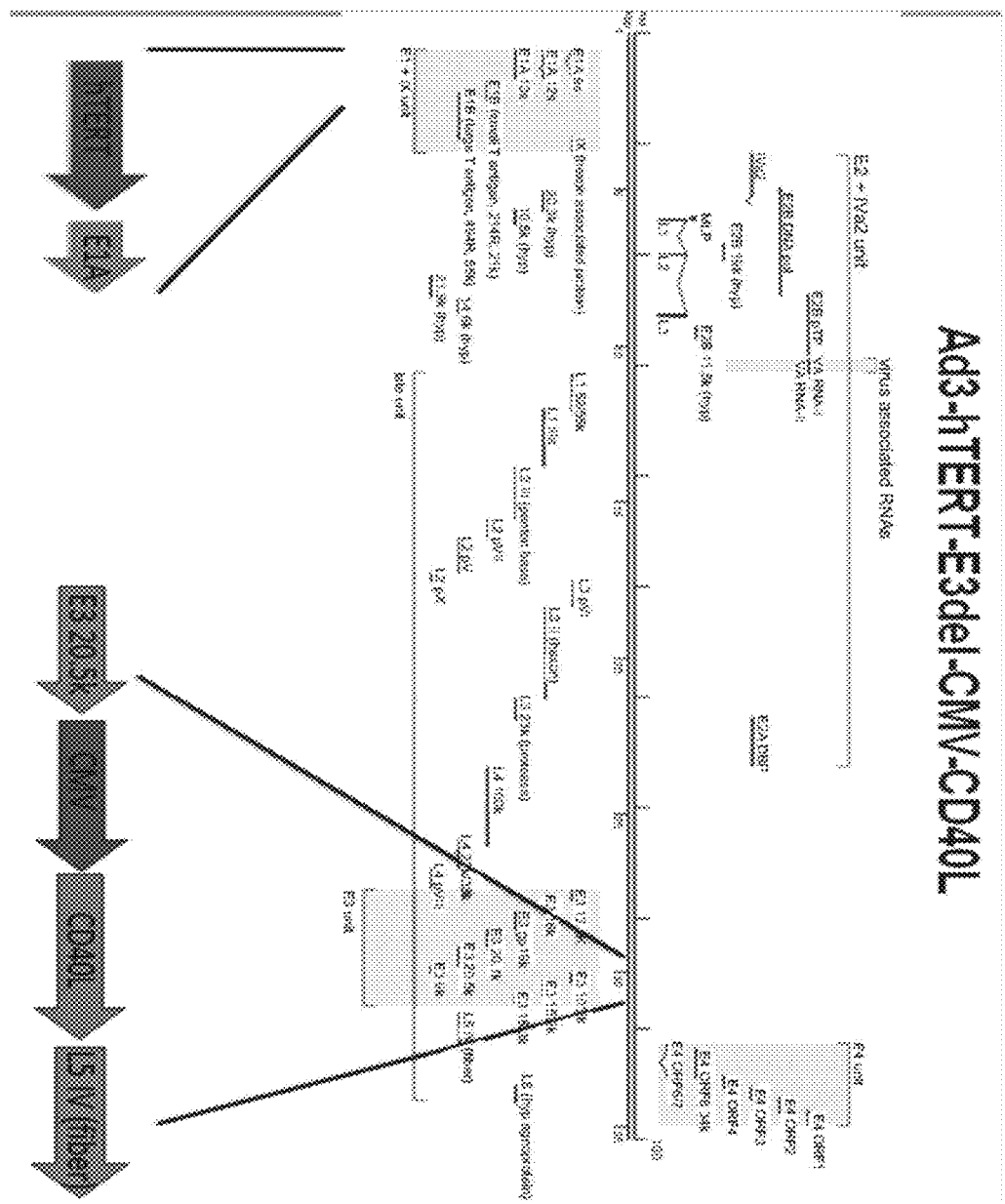

FIG. 37 shows the structure of Ad3-hTERT-E3del-CMV-CD40L vector. Nucleotide sequence of the viral vector Ad3-hTERT-E3del-CMV-CD40L is shown in SEQ ID NO 30.

Figure 38:
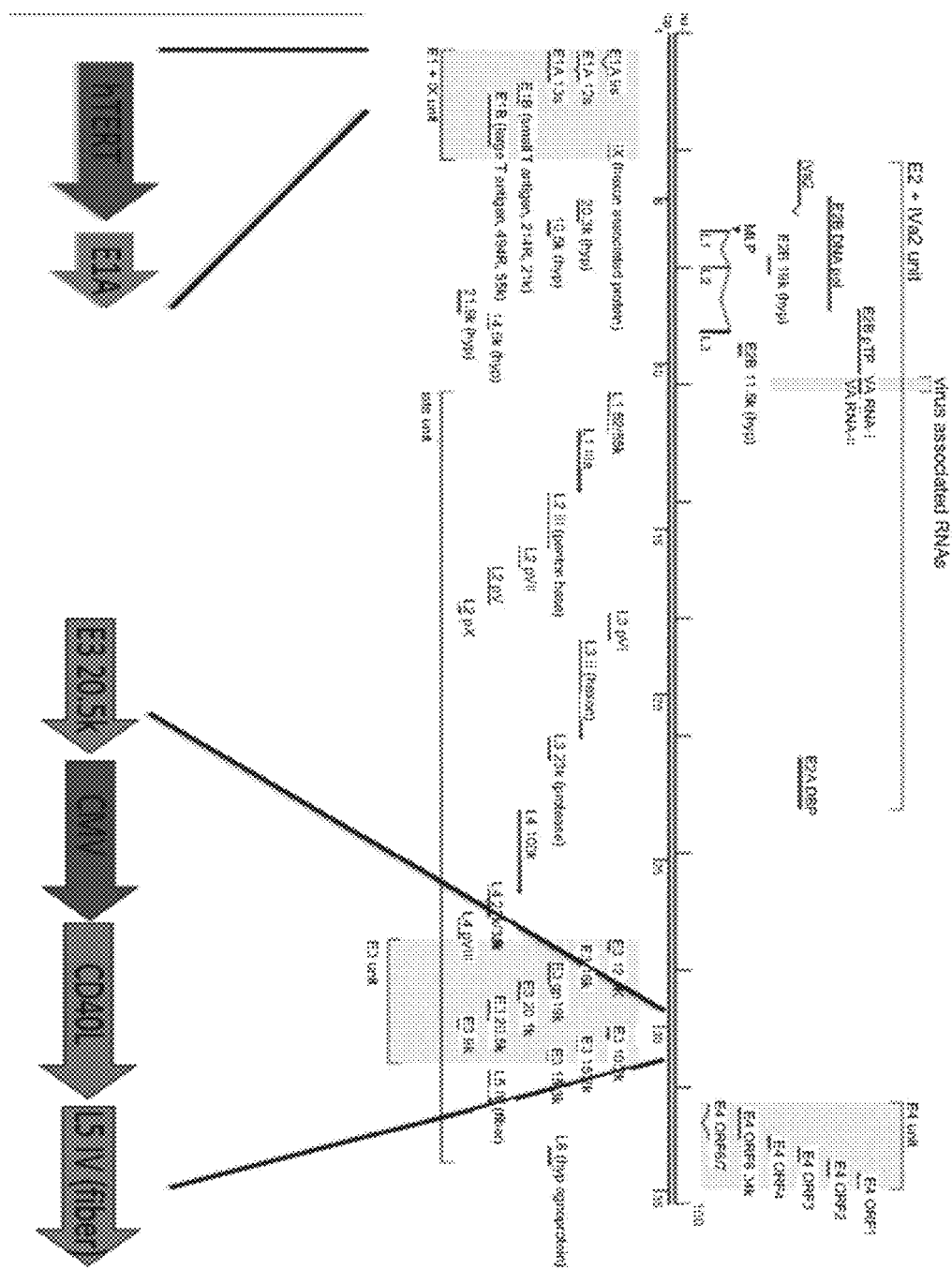

FIG. 38 shows the structure of Ad3-hTERT-E3del-E2F-CD40L vector. Nucleotide sequence of the viral vector Ad3-hTERT-E3del-E2F-CD40L is shown in SEQ ID NO 31.

Figure 39:
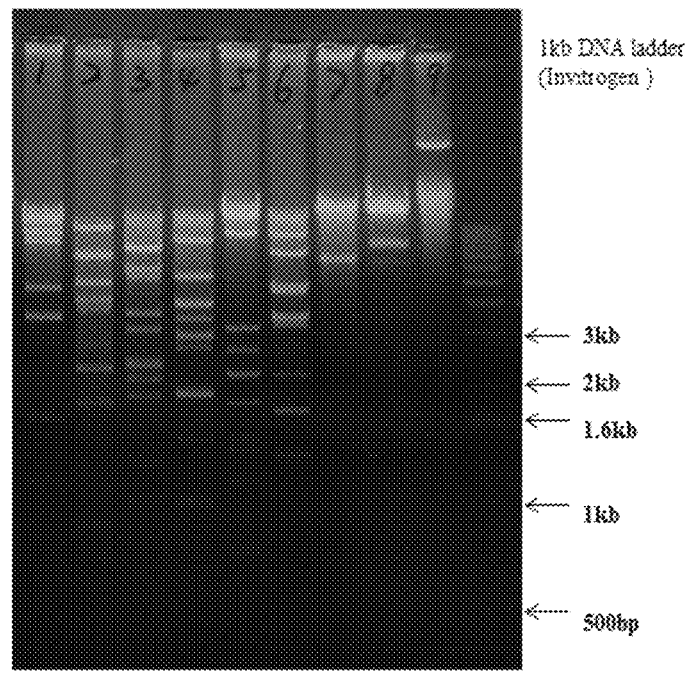

FIG. 39 shows an agarose gel of pWEA-Ad3-hTERT-CMV-CD40L vector cut with restriction enzymes. Correct restriction analyzes of the cloned virus vectors suggest correct DNA sequence for the virus.

Figure 40:
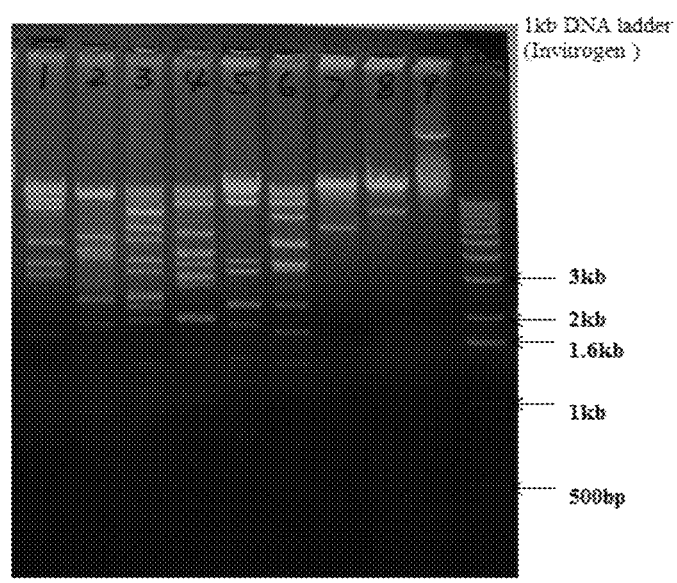

FIG. 40 shows an agarose gel of pWEA-Ad3-hTERT-E2F-CD40L vector cut with restriction enzymes. Correct restriction analyzes of the cloned virus vectors suggest correct DNA sequence for the virus.

Figure 41:
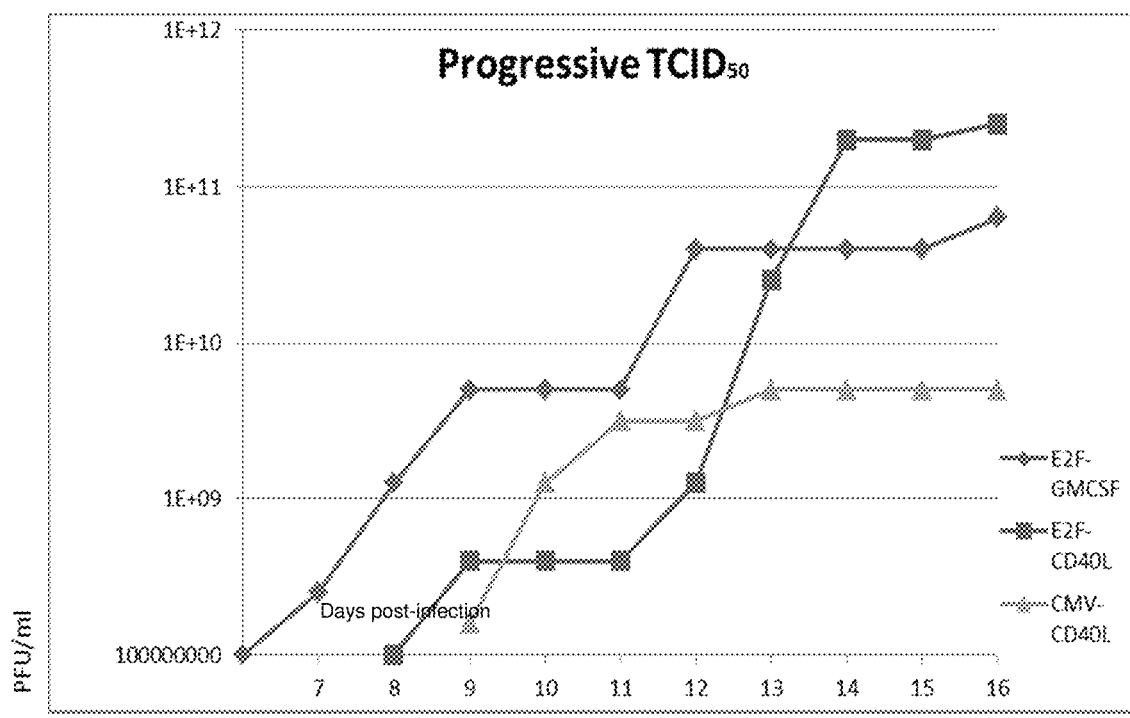

FIG. 41 shows functionality of E2F-CD40L and CMV-CD40L vectors in vitro. On the vertical axis the logarytmic scale of the relative visual titer the $TCID_{50}$ yields (PFU/ml). On the horizontal axis the days post infection (d). This showed that the viruses are functional and capable of infecting at least some tumour cell lines. The dilutions of virus were not made according to the VP-titers. Progressive $TCID_{50}$: The newly produced viruses were first tested with progressive $TCID_{50}$ to determine whether they have oncolytic properties. After nine (9) days of incubation the infections became visible in all culture plates of A549 cells, which indicated that all the new viruses were functional. During the following days the infections continued spreading accordingly to the amount of virus pipetted per cell. Slight differences were detected in the amount and speed of cell-lysis.

Figure 42:
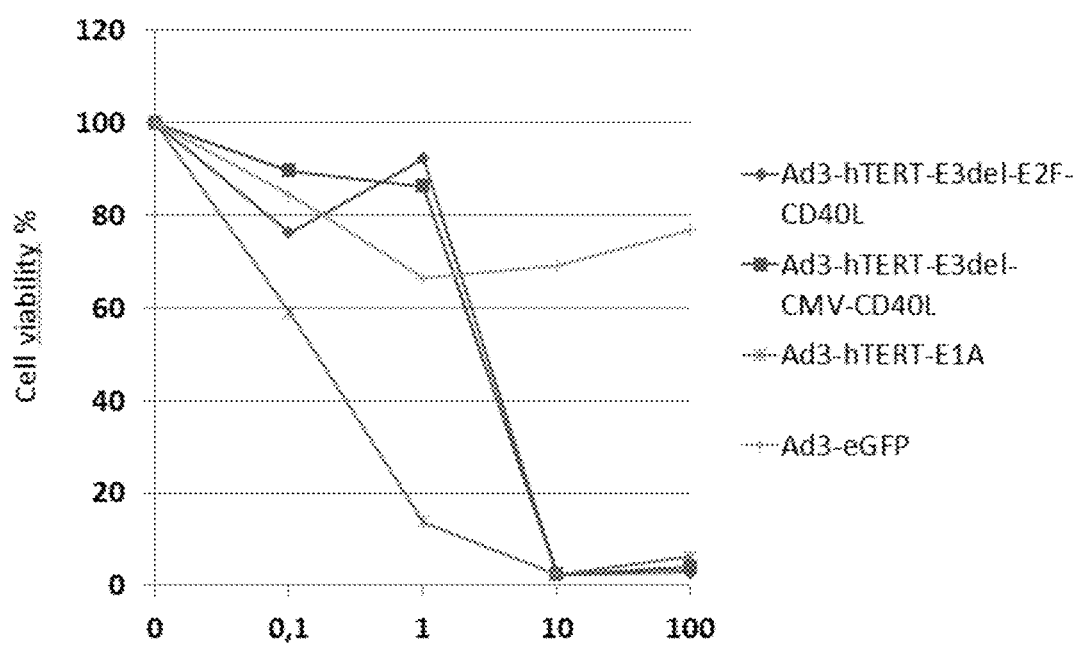
Figure 43:
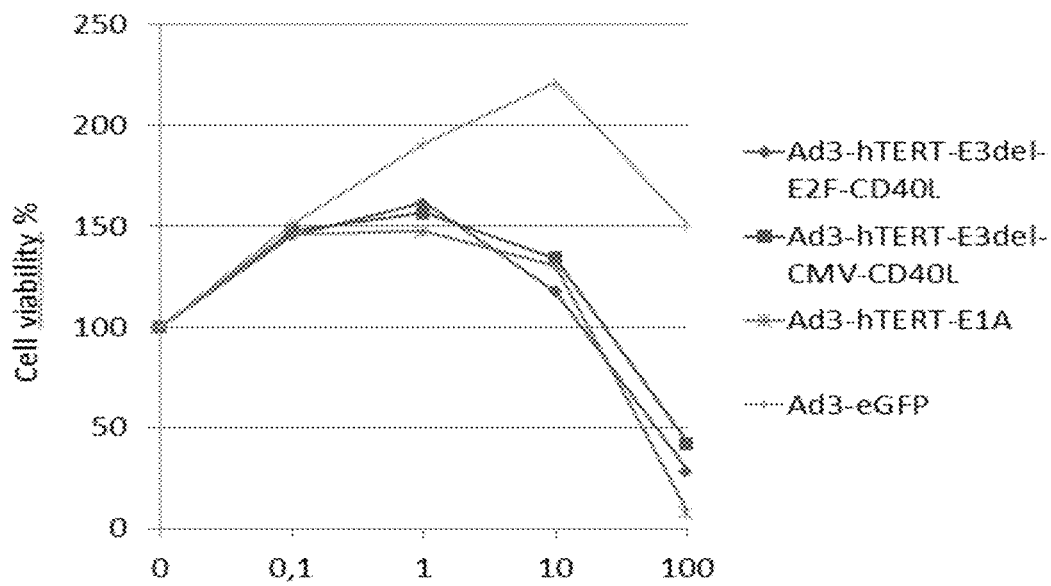
Figure 44:
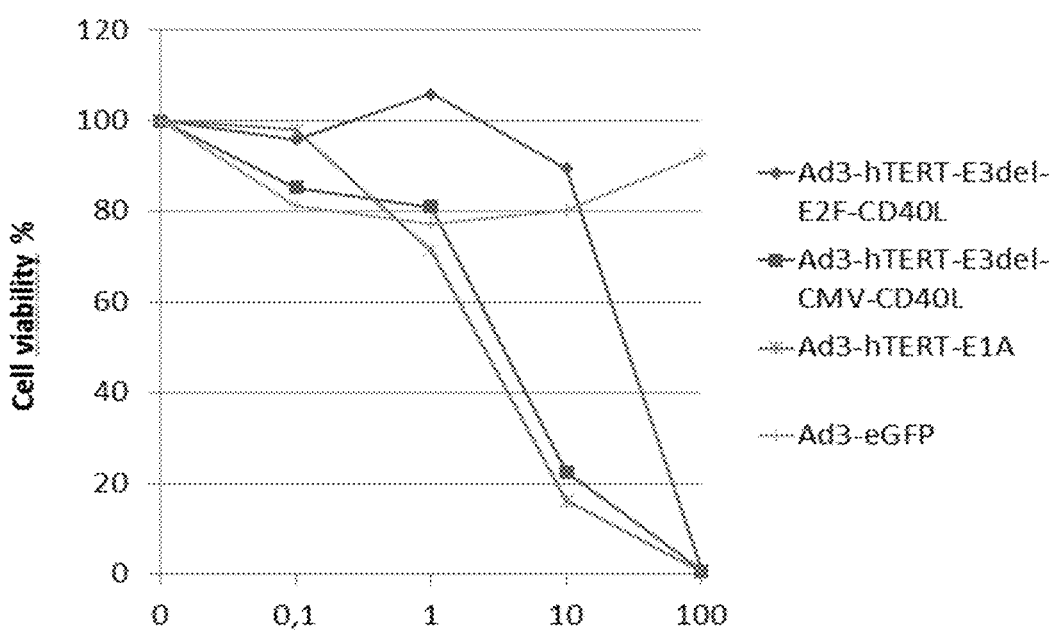

FIGS. 42-44 reveal that all oncolytic serotype 3 viruses showed significantly ($P<0.05$) better cell killing than the non-replicating Ad3eGFP control virus in A549 lung cancer cells, PC3-MM2 prostate cancer cells and SKOV3 ovarian cancer cells. No significant difference between the oncolytic Ad3 viruses could be seen suggesting that all virus constructs are fully functional and that the E3 area deletion, the inserted promoters (CMV or E2F) or the inserted transgene (CD40L) do not affect the oncolytic potency in vitro.

Figure 45:
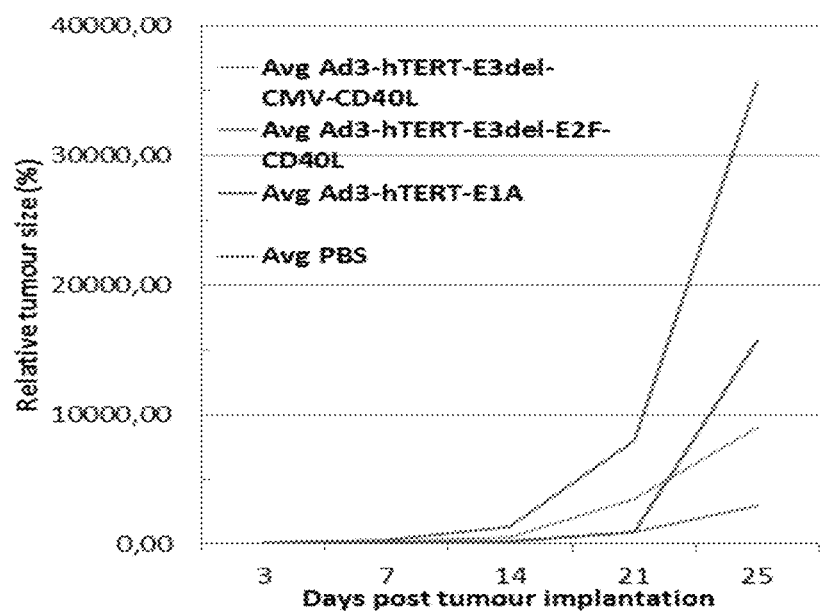

FIG. 45 shows anti-tumor efficacy of Ad3 based viruses in vivo: orthotopic intraperitoneal ovarian cancer model. Ad3-hTERT-E3del-E2F-CD40L had the best anti-tumor efficacy. ELISA confirmed CD40L release into the blood stream.

Figure 46:
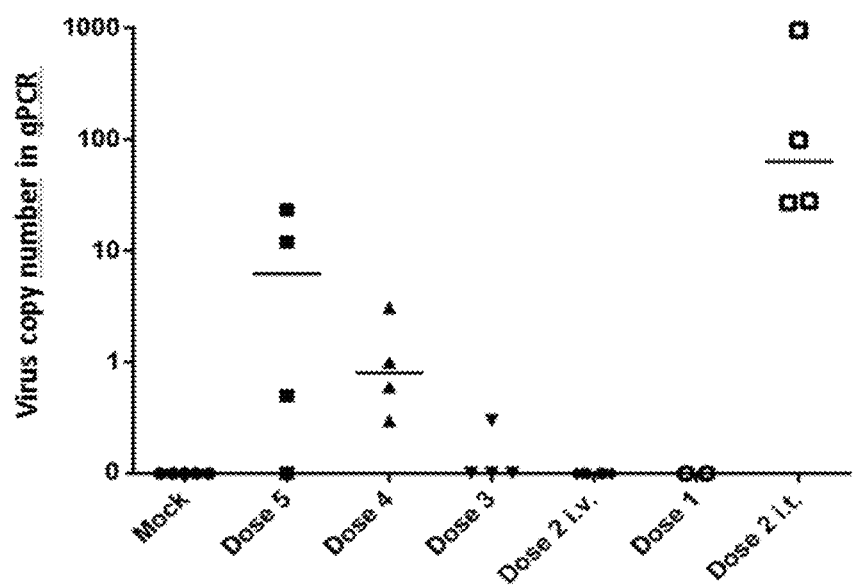

FIG. 46 shows a therapeutic window of oncolytic adenovirus coding for murine CD40L in immunocompetent mice. DOSE 5: $1\times10^{11}$ VP/mouse; DOSE 4: $3\times10^{10}$ VP/mouse; DOSE 3: $1\times10^{10}$ VP/mouse; DOSE 2: $1\times10^{9}$ VP/mouse; DOSE 1: $1\times10^{8}$ VP/mouse; Positive control (DOSE 2 intratumorally.) With dose 5, 67% of mice had signs of liver toxicity. Dose 4 was able to achieve good tumor transduction following i.v. delivery, without signs of liver toxicity.

Figure 47:
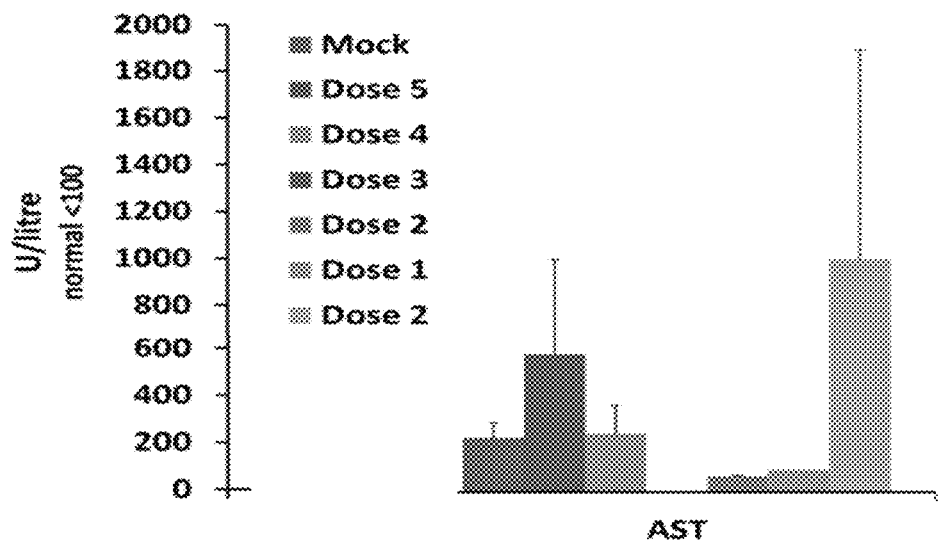

FIG. 47 shows liver enzyme release in mice treated through the intravenous route with oncolytic adenovirus coding for murine CD40L in immunocompetent mice. There was not much liver toxicity, as measured by liver enzyme release, in any intravenous treatment groups (DOSE 1-5). Last bar indicates DOSE 2 given intratumorally. However, in DOSE 5 there was liver toxicity in visual inspection->DOSE 4 is maximum tolerated dose for intravenous delivery. (the doses from mock to dose 2 are represented as bars from left to right)

Figure 48:
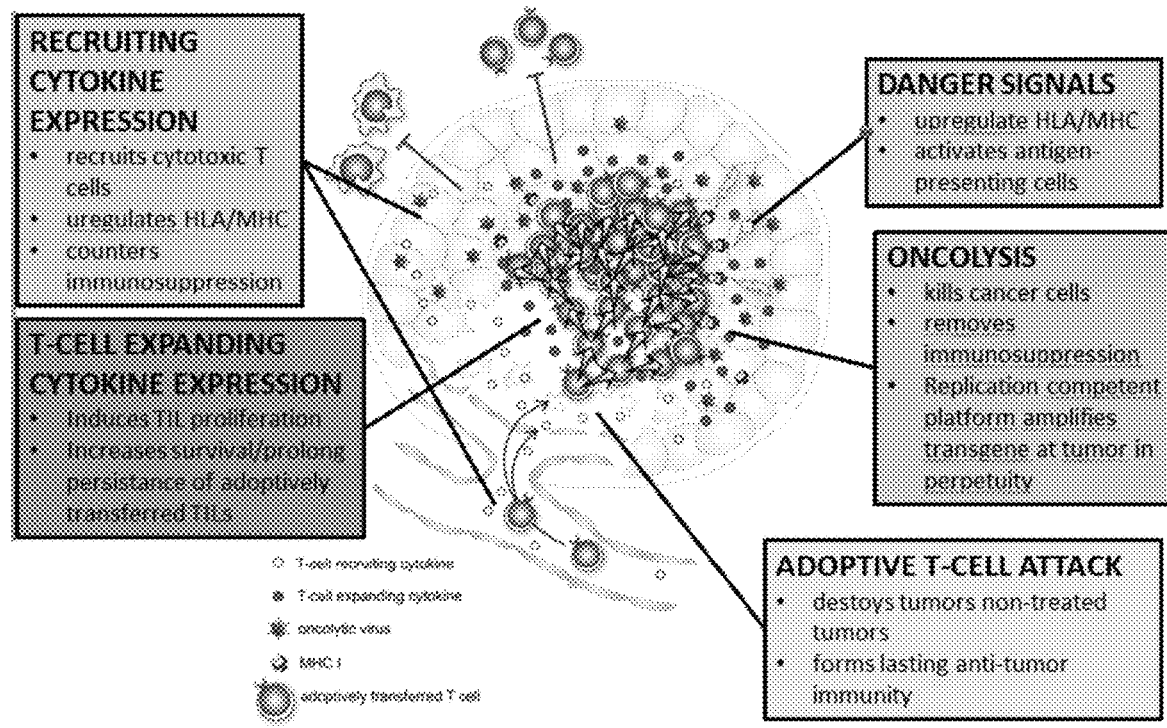

FIG. 48 shows mechanisms of enhancement of adoptive cell therapy by dual cytokine-expressing virus. Virus infection and innate sensing of virus particles induces danger signals, which includes upregulation of HLA/MHC class I molecules on cancer cells, activation and maturation of antigen presenting cells and secretion of immune cell-recruiting cytokines. Danger signals are further amplified by tumor cell death with oncolytic viruses, which also releases tumor antigens and increases recognition of tumor tissue by the immune system. Viruses express two cytokines: the T cell recruiting cytokine attracts adoptively transferred T cells into the tumor, and the T cell expanding cytokine, in a specific embodiment interleukin 2, increases and maintains their proliferation.

Figure 49:
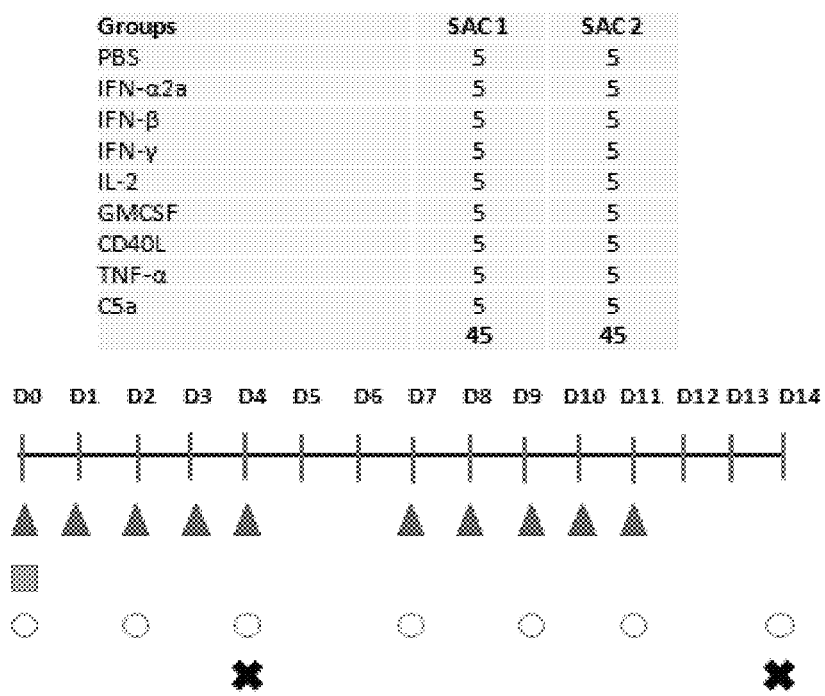

FIG. 49 shows schematics of the trafficking experiment with recombinant mouse cytokines. B16-OVA bearing C57BL/6 female mice are adoptively transferred with $2.0*10^{6}$ CD8a+ enriched OT-I lymphocytes (box) i.p. on day 0 and treated with intratumoral injections of recombinant murine cytokines (triangles) on workdays. Tumor growth is monitored and recorded thrice a week (circles) by using electronic calipers. Mice are sacrificed (X) at two different time points (SAC1 and SAC2), tumors are harvested and samples are analyzed using OT-I qPCR and T-cell FACS analysis.

Figure 50:
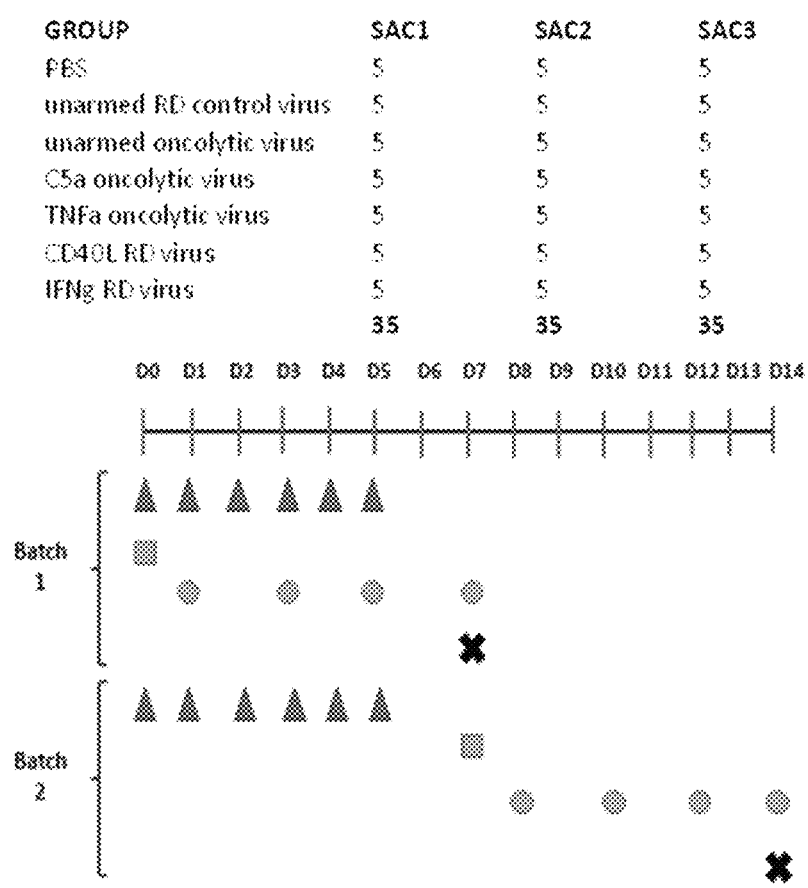

FIG. 50 shows schematics of the trafficking experiment with adenoviruses coding for mouse cytokines. B16-OVA bearing C57BL/6 female mice are adoptively transferred with $2.0*10^{6}$ CD8a+ enriched OT-I lymphocytes (box) i.p. on day 0 and intratumorally treated with adenoviruses armed with different mouse cytokines (red triangles) on workdays. Tumor growth is monitored and recorded thrice a week (circles) by using electronic calipers. Mice are sacrificed (X) at two different time points (SAC1 and SAC2), tumors are harvested and samples analyzed using OT-I qPCR and T-cell FACS analysis.

Figure 51:
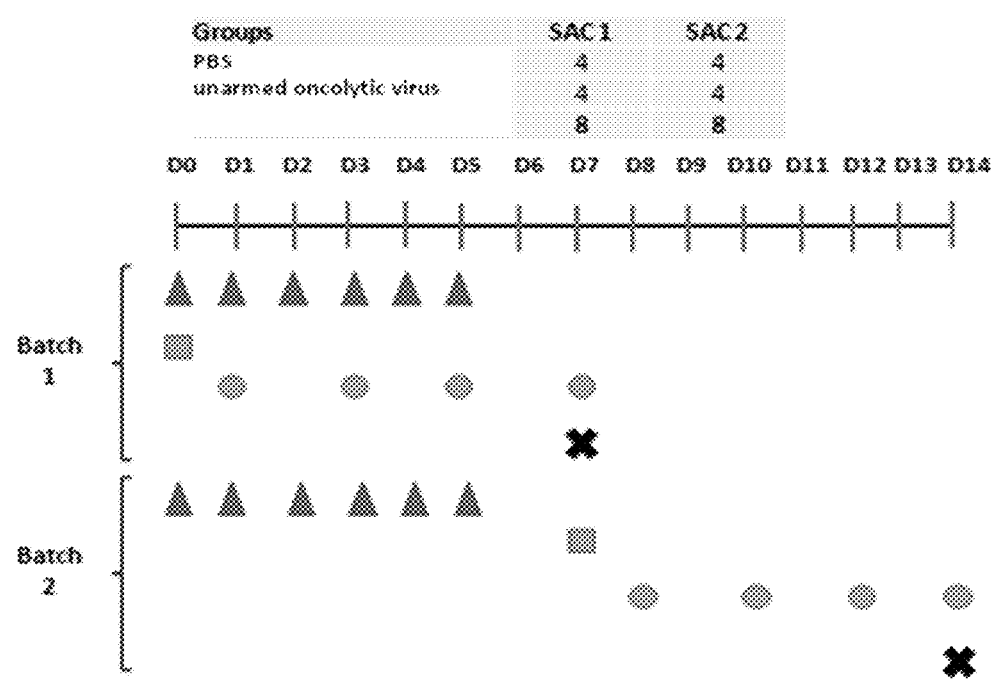

FIG. 51 shows schematics of the trafficking experiment with using 111In radiolabeled OT-I cells and SPECT/CT imaging. B16-OVA bearing C57BL/6 female mice are intratumorally injected with 1e9 VP of 5/3 chimeric virus (triangles) on six consecutive days. First group of mice will receive adoptive transfer of $2.0*10^{6}$ CD8a+ enriched, indium oxine labeled OT-I lymphocytes (box) i.v. on day 0 and the other group of mice on day 7. Accumulation of OT-I cells into tumors is quantitated by SPECT/CT imaging (circles). Mice are sacrificed (X) at two different time points (SAC1 and SAC2), tumors are harvested and their final radioactivity is measured.

DETAILED DESCRIPTION OF THE INVENTION

Adoptive Cell Therapy

The general approach of the present invention is the development of a treatment for patients with cancer using the transfer of immune lymphocytes that are capable of reacting with and destroying the cancer. Isolated tumor infiltrating lymphocytes are grown in culture to large numbers and infused into the patient. In the present invention adenoviral vectors coding for at least one cytokine are utilized for increasing the effect of lymphocytes. Separate administrations of an adoptive cell therapeutic composition and adenoviral vectors are frequently preceded by myeloablating or non-myeloablating preconditioning chemotherapy and/or radiation. The adoptive cell therapy treatment is intended to reduce or eliminate cancer in the patient. (FIG. 21)

This invention relates to therapies with an adoptive cell therapeutic composition, e.g. tumor infiltrating lymphocytes, TCR modified lymphocytes or CAR modified lymphocytes. This invention relates to T-cell therapies in particular, but also other adoptive therapies such as NK cell therapies or other cell therapies. Indeed, according to the present invention the adoptive cell therapeutic composition may comprise unmodified cells such as in TIL therapy or genetically modified cells. There are two common ways to achieve genetic targeting of T-cells to tumor specific targets. One is transfer of a T-cell receptor with known specificity (TCR therapy) and with matched human leukocyte antigen (HLA, known as major histocompatibility complex in rodents) type. The other is modification of cells with artificial molecules such as chimeric antigen receptors (CAR). This approach is not dependent on HLA and is more flexible with regard to targeting molecules. For example, single chain antibodies can be used and CARs can also incorporate co-stimulatory domains. However, the targets of CAR cells need to be on the membrane of target cells, while TCR modifications can utilize intracellular targets.

As used herein "adoptive cell therapeutic composition" refers to any composition comprising cells suitable for adoptive cell transfer. In one embodiment of the invention the adoptive cell therapeutic composition comprises a cell type selected from a group consisting of a tumor infiltrating lymphocyte (TIL), TCR (i.e. heterologous T-cell receptor) modified lymphocytes and CAR (i.e. chimeric antigen receptor) modified lymphocytes. In another embodiment of the invention, the adoptive cell therapeutic composition comprises a cell type selected from a group consisting of T-cells, CD8+ cells, CD4+ cells, NK-cells, delta-gamma T-cells, regulatory T-cells and peripheral blood mononuclear cells. In another embodiment, TILs, T-cells, CD8+ cells, CD4+ cells, NK-cells, delta-gamma T-cells, regulatory T-cells or peripheral blood mononuclear cells form the adoptive cell therapeutic composition. In one specific embodiment of the invention the adoptive cell therapeutic composition comprises T cells. As used herein "tumor-infiltrating lymphocytes" or TILs refer to white blood cells that have left the bloodstream and migrated into a tumor. Lymphocytes can be divided into three groups including B cells, T cells and natural killer cells. In another specific embodiment of the invention the adoptive cell therapeutic composition comprises T-cells which have been modified with target-specific chimeric antigen receptors or specifically selected T-cell receptors. As used herein "T-cells" refers to CD3+ cells, including CD4+ helper cells, CD8+ cytotoxic T-cells and γδ T cells.

In addition to suitable cells, adoptive cell therapeutic composition used in the present invention may comprise any other agents such as pharmaceutically acceptable carriers, buffers, excipients, adjuvants, additives, antiseptics, filling, stabilising and/or thickening agents, and/or any components normally found in corresponding products. Selection of suitable ingredients and appropriate manufacturing methods for formulating the compositions belongs to general knowledge of a man skilled in the art.

The adoptive cell therapeutic composition may be in any form, such as solid, semisolid or liquid form, suitable for administration. A formulation can be selected from a group consisting of, but not limited to, solutions, emulsions, suspensions, tablets, pellets and capsules. The compositions are not limited to a certain formulation, instead the composition can be formulated into any known pharmaceutically acceptable formulation. The pharmaceutical compositions may be produced by any conventional processes known in the art.

Viral Vectors

The oncolytic adenoviral vectors used in the present invention can be any adenoviral vectors suitable for treating a human or animal. In one embodiment of the invention, the adenoviral vectors are vectors of human viruses, and can be selected from a group consisting of Ad5, Ad3 and Ad5/3 vectors. In another embodiment, the vector is Ad5 or Ad5/3 vector.

As used herein "an oncolytic adenoviral vector" refers to an adenoviral vector capable of infecting and killing cancer cells by selective replication in tumor versus normal cells.

The vectors may be modified in any way known in the art, e.g. by deleting, inserting, mutating or modifying any viral areas. The vectors are made tumor specific with regard to replication. For example, the adenoviral vector may comprise modifications in E1, E3 and/or E4 such as insertion of tumor specific promoters (eg. to drive E1), deletions of areas (e.g. the constant region 2 of E1 as used in "D24", E3/gp19k, E3/6.7 k) and insertion of transgenes. Furthermore, fiber knob areas of the vector can be modified. In one embodiment of the invention the adenoviral vector is Ad5/3 comprising an Ad5 nucleic acid backbone and Ad3 fiber knob or Ad5/3 chimeric fiber knob.

As used herein, expression "adenovirus serotype 5 (Ad5) nucleic acid backbone" refers to the genome of Ad5. Similarly "adenovirus serotype 3 (Ad3) nucleic acid backbone" refers to the genome of Ad3. "Ad5/3 vector" refers to a chimeric vector having parts of both Ad5 and Ad3 vectors. In a specific embodiment of the invention, the capsid modification of the vector is Ad5/3 chimerism. As used herein, "Ad5/3 chimeric fiber knob" refers to a chimerism, wherein the knob part of the fiber is from Ad serotype 3, and the rest of the fiber is from Ad serotype 5. Specifically, in one embodiment, the construct has the fiber knob from Ad3 while the remainder of the genome is from Ad5. (See FIGS. 17, 33 and 34)

One approach for generation of a tumor specific oncolytic adenovirus is engineering a 24 base pair deletion (D24) affecting the constant region 2 (CR2) of E1. In wild type adenovirus CR2 is responsible for binding the cellular Rb tumor suppressor/cell cycle regulator protein for induction of the synthesis (S) phase i.e. DNA synthesis or replication phase. The interaction between pRb and E1A requires eight amino acids 121 to 127 of the E1A protein conserved region, which are deleted in the present invention. The vector of the present invention comprises a deletion of nucleotides corresponding to amino acids 122-129 of the vector according to Heise C. et al. (2000, Nature Med 6, 1134-1139). Viruses with the D24 are known to have a reduced ability to overcome the G1-S checkpoint and replicate efficiently only in cells where this interaction is not necessary, e.g. in tumor cells defective in the Rb-p16 pathway, which includes most if not all human tumors. (See FIGS. 17, 33 and 34)

It is also possible to replace E1A endogenous viral promoter for example by a tumor specific promoter. In a specific embodiment of the invention hTERT promoter is utilized in the place of E1A endogenous viral promoter.

The E3 region is nonessential for viral replication in vitro, but the E3 proteins have an important role in the regulation of host immune response i.e. in the inhibition of both innate and specific immune responses. The gp19k/6.7K deletion in E3 refers to a deletion of 965 base pairs from the adenoviral E3A region. In a resulting adenoviral construct, both gp19k and 6.7 K genes are deleted (Kanerva A et al. 2005, Gene Therapy 12, 87-94). The gp19k gene product is known to bind and sequester major histocompatibility complex I (MHC1, known as HLA1 in humans) molecules in the endoplasmic reticulum, and to prevent the recognition of infected cells by cytotoxic T-lymphocytes. Since many tumors are deficient in HLA1/MHC1, deletion of gp19k increases tumor selectivity of viruses (virus is cleared faster than wild type virus from normal cells but there is no difference in tumor cells). 6.7 K proteins are expressed on cellular surfaces and they take part in down regulating TNF-related apoptosis inducing ligand (TRAIL) receptor 2. (See FIGS. 17, 33 and 34)

Both of these deletions provide a surprising advantage with regard to our invention. Since we are attempting to regain expression of HLA/MHC for presentation of tumor epitopes to the adoptively transferred T-cells, expression of the gp19k protein is counterproductive and in fact the up regulation of HLA/MHC requires deletion of gp19k. With regard to 6.7 k, since an embodiment of our invention is production of TNFalpha from the virus, and one of its anti-tumor activities is a direct anti-tumor proapoptotic effect (on both transduced and non-transduced bystander cells), the presence of 6.7 k is counterproductive.

In one embodiment of the invention, the cytokine transgene or transgenes are placed into a gp19k/6.7k deleted E3 region, under the E3 promoter. This restricts transgene expression to tumor cells that allow replication of the virus and subsequent activation of the E3 promoter. E3 promoter may be any exogenous (e.g. CMV or E2F promoter) or endogenous promoter known in the art, specifically the endogenous E3 promoter. Although the E3 promoter is chiefly activated by replication, some expression occurs when E1 is expressed. As the selectivity of D24 type viruses occurs post E1 expression (when E1 is unable to bind Rb), these viruses do express E1 also in transduced normal cells. Thus, it is of critical importance to regulate also E1 expression to restrict E3 promoter mediated transgene expression to tumor cells.

In another embodiment of the invention E3 gp19k/6.7k is kept in the vector but one or many other E3 areas have been deleted (e.g. E3 9-kDa, E3 10.2 kDa, E3 15.2 kDa and/or E3 15.3 kDa).

In a specific embodiment of the invention the oncolytic adenoviral vector is based on an adenovirus serotype 5 (Ad5) nucleic acid backbone comprising a 5/3 chimeric fiber knob, and comprising the following: E2F1 promoter for tumor specific expression of E1A, a 24 bp deletion (D24) in the Rb binding constant region 2 of adenoviral E1, a nucleic acid sequence deletion of viral gp19k and 6.7 k reading frames, with a transgene insertion into the deleted region, resulting in replication-associated control of transgene expression under the viral E3 promoter, and a nucleic acid sequence encoding at least one cytokine transgene in the place of the deleted adenoviral genes gp19k/6.7K in the E3 region (FIG. 17). In one embodiment of the invention, the adenoviral vector is based on a human adenovirus. (See FIGS. 17, 33 and 34)

In another specific embodiment of the invention the oncolytic adenoviral vector is based on an adenovirus serotype 3 (Ad3) nucleic acid backbone, and comprises the following: a deletion in the E3 area, and a tumor specific promoter (e.g. CMV or E2F) for expression of a transgene (e.g. CD40L) in the place of the deleted area of E3. In one embodiment of the invention, the adenoviral vector is based on a human adenovirus. (See FIGS. 37 and 38, corresponding nucleotide sequences of the viral vectors Ad3-hTERT-E3del-CMV-CD40L and Ad3-hTERT-E3del-E2F-CD40L is shown in SEQ ID NOs 30 and 31)

The exact functions of the Early Region (E3) proteins in adenovirus 3 are not known. Generally in adenoviruses they do not seem to impair replication when deleted and they seem to affect anti-viral host response to adenoviruses (Wold et al., 1999). The E3 of the human adenovirus genome contains the highest level of genetic diversity among the six species (A-F) of adenoviruses found in humans. This diversity in genetic content is primarily located between the highly conserved E3-gp19K and E3-RIDα open reading frames (ORFs) where species-specific arrays of genes are encoded (Burgert and Blusch, 2000).

Cytotoxic T-cell mediated killing of viral-infected cells is modulated by E3-gp19K. This is accomplished by blocking transport of MHC class I to the plasma membrane, and inhibiting the TAP-MHC class I complex formation (Andersson et al., 1985; Andersson et al., 1987; Burgert and Kvist, 2002, Bennet et al., 1999).

Thus, in one aspect of the invention the important molecule E3-gp19K is comprised in the adenoviral vector to make virus replication more stealthy and enable more time for oncolysis and its beneficial effects. Also, retaining E3-gp19K can reduce induction of anti-adenovirus-cytotoxic T-cells, resulting in more anti-tumor T-cells.

In one embodiment of the invention the oncolytic adenoviral vector is based on an adenovirus serotype 3 (Ad3) nucleic acid backbone, and comprises the following: a promoter (e.g. hTERT) for tumor specific expression of E1A, a deletion in the E3 area (e.g. a deletion affecting E3 9-kDa, E3 10.2 kDa, E3 15.2 kDa and E3 15.3 kDa), and a tumor specific promoter (e.g. CMV or E2F) for expression of a transgene (e.g. CD40L) in the place of the deleted area of E3. In one embodiment of the invention, the nucleic acid backbone of the vector is fully adenovirus serotype 3. In one embodiment of the invention in Ad3 delE3 viruses the following features have been deleted: E3 9-kDa, E3 10.2-kDa, E3 15.2-kDa, E3 15.3-kDa and furthermore, CD40L with a promoter (CMV or E2F) has been inserted in their place. These viruses induce apoptosis of tumor cells and triggers several immune mechanisms, including a T-helper type 1 (TH1) response, which leads to activation of cytotoxic T cells and reduction of immunosuppression.

Cytokines participate in immune response by acting through various mechanisms including recruitment of T-cells towards the tumor. The nucleotide sequence encoding a cytokine transgene may be from any animal such as a human, ape, rat, mouse, hamster, dog or cat, but specifically it is encoded by a human sequence. The nucleotide sequence encoding the transgene may be modified in order to improve its effects, or unmodified i.e. of a wild type.

Particular embodiments of the present invention include viral vectors coding for at least one cytokine. Cytokines used in the present invention can be selected from any known cytokines in the art. In one embodiment of the invention the cytokine is selected from a group consisting of interferon alpha, interferon beta, interferon gamma, complement C5a, IL-2, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5, CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2. In a specific embodiment of the invention the cytokine is IL-2 or TNFalpha. In another embodiment of the invention the cytokine or cytokines is/are selected from a chemokine group consisting of CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5, CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2.

The viral vectors of the invention may code for one, two, three, four, five or more cytokines. In one embodiment of the invention the oncolytic adenoviral vector codes for two or more cytokines, most specifically two. These two cytokines may be any known cytokines, for example including but not limited to the ones listed above, with the addition of GMCSF. The two cytokines may be different cytokines. In one embodiment of the invention the oncolytic adenoviral vector codes for any two or more cytokines selected from a cytokine group consisting of interferon alpha, interferon beta, interferon gamma, complement C5a, GMCSF, IL-2, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5, CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2, or the oncolytic adenoviral vector codes for IL-2 and a cytokine or cytokines selected from a cytokine group consisting of interferon alpha, interferon beta, interferon gamma, complement C5a, GMCSF, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5, CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2. In a specific embodiment of the invention the cytokines are IL-2 and TNFalpha. The other cytokine functions by attracting and activating the T cells and reducing tumor immunosuppression, while IL-2 induces the propagation of the T-cell graft. Thus, IL-2 is produced locally at the tumor where it is needed, instead of injected systemically as is typically done in T-cell therapy, which can cause side effects, and therefore a major problem of the prior art therapies (i.e. toxicity of systemic IL-2) can be prevented by this embodiment.

The danger signaling provided by replication of the oncolytic virus, and activation of pathogen associated molecular pattern recognition receptors by viral DNA, together with the action of the transgene(s) may reduce tumor immunosuppression to such degree that preconditioning therapy can be omitted. Consequently, and major issue in prior art, toxicity due to preconditioning chemotherapy and radiation can be avoided.

In one embodiment of the invention the virus vector comprises an internal ribosomal entry site (IRES) or optionally a ribosome shunt site 2A between the two transgenes. Thus, IRES or a ribosome shunt site 2A may be between any cytokines, such as IL-2 and any other cytokine selected from the above listed cytokine group. As used herein "IRES" refers to a nucleotide sequence that enables initiation of the translation in the middle of a messenger RNA sequence in protein synthesis. IRES can be from any virus, but in one embodiment of the invention IRES is from encephalomyocarditis virus (EMCV). As used herein "a ribosome shunt site 2A" refers to a translation initiation site in which ribosomes physically bypass parts of the 5' untranslated region to reach the initiation codon. Both the IRES and the A2 enable viruses to produce two transgenes from one promoter (the E3 promoter).

Schematics of the general layouts of the virus genomes, which may be used in the present invention, are shown in FIGS. 17, 33, 34, 37 and 38. Nucleotide sequences of the viral vectors comprising transgenes C5a, hCD40L, hIFNa2, hIFNb1, hIFNg1, hIL2 or TNFalpha are shown in SEQ ID NOs 1-7, respectively (Ad5/3-E2F-D24-transgene). Nucleotide sequences of the viral vectors comprising CD40L are also shown in SEQ ID NOs 30 and 31 (Ad3-hTERT-E3del-CMV-CD40L and Ad3-hTERT-E3del-E2F-CD40L). Furthermore, nucleotide sequences of the viral vectors comprising two transgenes, the other one being IL-2 and the other one C5a, CD40L, IFNa2, IFNb, IFNg, GMCSF or TNFalpha, are shown in SEQ ID NOs 8-21 (SEQ ID NO: 8 C5a-2A-IL2, SEQ ID NO: 9 IFNa-2A-IL2, SEQ ID NO: 10 TNFalpha-2A-IL2, SEQ ID NO: 11 CD40L-2A-IL2, SEQ ID NO: 12 IFNb-2A-IL2, SEQ ID NO: 13 GMCSF-2A-IL2, SEQ ID NO: 14 IFNg-2A-IL2, SEQ ID NO: 15 C5a-IRES-IL2, SEQ ID NO: 16 IFNa-IRES-IL2, SEQ ID NO: 17 TNFalpha-IRES-IL2, SEQ ID NO: 18 CD40L-IRES-IL2, SEQ ID NO: 19 IFNb-IRES-IL2, SEQ ID NO: 20 GMCSF-IRES-IL2, SEQ ID NO: 21 IFNg-IRES-IL2) (Ad5/3-E2F-D24-trans gene-IRES/2A-trans gene).

In summary, the key advantages of the present invention utilizing viral vectors comprising at least one cytokine transgene are: i) cytokines and virus per se cause a danger signal which recruits T cells and other immune cells to tumors, ii) cytokines induce T cell proliferation both at the tumor and in local lymphoid organs, iii) cytokines and virus per se are able to induce T cells (both the adoptive T-cell graft and natural, innate anti-tumor T-cells) to propagate at the tumor, iv) cytokine and/or virus induce the up regulation of antigen-presenting molecules (HLA) on cancer cells, rendering them sensitive to recognition and killing by T cells, and v) cytokines and virus replication favorably alter tumor microenvironment by reducing immunosuppression and cellular anergy.

The viral vectors utilized in the present inventions may also comprise other modifications than described above. Any additional components or modifications may optionally be used but are not obligatory for the present invention.

Insertion of exogenous elements may enhance effects of vectors in target cells. The use of exogenous tissue or tumor-specific promoters is common in recombinant vectors and they can also be utilized in the present invention.

In summary, the present invention reveals that the replication of oncolytic virus can recruit T-cells and induce danger signals at the tumor, reducing immunosuppression and cellular anergy. These effects are mediated through pathogen associated molecular pattern recognition receptors, an evolutionarily conserved mechanism for inducing immunity and not subject to tolerance. The present invention also reveals that an added benefit of the oncolytic platform, capable of replication in tumors but not normal cells, is self-amplification at the tumor. In addition, the oncolytic effect per se may add to the overall anti-tumor effect in humans.

Cancer

The recombinant vectors of the present invention are replication competent in tumor cells. In one embodiment of the invention the vectors are replication competent in cells, which have defects in the Rb-pathway, specifically Rb-p16 pathway. These defective cells include all tumor cells in animals and humans. As used herein "defects in the Rb-pathway" refers to mutations and/or epigenetic changes in any genes or proteins of the pathway. Due to these defects, tumor cells overexpress E2F and thus, binding of Rb by E1A CR2, that is normally needed for effective replication, is unnecessary. Further selectivity is mediated by the E2F promoter, which only activates in the presence of free E2F, as seen in Rb/p16 pathway defective cells. In the absence of free E2F, no transcription of E1A occurs and the virus does not replicate. Inclusion of the E2F promoter is important to prevent expression of E1A in normal tissues, which can cause toxicity both directly and indirectly through allowing transgene expression from the E3 promoter.

The present invention relates to approaches for treating cancer in a subject. In one embodiment of the invention, the subject is a human or an animal, specifically an animal or human patient, more specifically a human or an animal suffering from cancer.

The approach can be used to treat any cancers or tumors, including both malignant and benign tumors, both primary tumors and metastases may be targets of the approach. In one embodiment of the invention the cancer features tumor infiltrating lymphocytes. The tools of the present invention are particularly appealing for treatment of metastatic solid tumors featuring tumor infiltrating lymphocytes. In another embodiment the T-cell graft has been modified by a tumor or tissue specific T-cell receptor of chimeric antigen receptor.

As used herein, the term "treatment" or "treating" refers to administration of at least oncolytic adenoviral vectors or at least oncolytic adenoviral vectors and adoptive cell therapeutic composition to a subject, preferably a mammal or human subject, for purposes which include not only complete cure but also prophylaxis, amelioration, or alleviation of disorders or symptoms related to a cancer or tumor. Therapeutic effect may be assessed by monitoring the symptoms of a patient, tumor markers in blood or for example a size of a tumor or the length of survival of the patient In another embodiment of the invention the cancer is selected from a group consisting of nasopharyngeal cancer, synovial cancer, hepatocellular cancer, renal cancer, cancer of connective tissues, melanoma, lung cancer, bowel cancer, colon cancer, rectal cancer, colorectal cancer, brain cancer, throat cancer, oral cancer, liver cancer, bone cancer, pancreatic cancer, choriocarcinoma, gastrinoma, pheochromocytoma, prolactinoma, T-cell leukemia/lymphoma, neuroma, von Hippel-Lindau disease, Zollinger-Ellison syndrome, adrenal cancer, anal cancer, bile duct cancer, bladder cancer, ureter cancer, brain cancer, oligodendroglioma, neuroblastoma, meningioma, spinal cord tumor, bone cancer, osteochondroma, chondrosarcoma, Ewing's sarcoma, cancer of unknown primary site, carcinoid, carcinoid of gastrointestinal tract, fibrosarcoma, breast cancer, Paget's disease, cervical cancer, colorectal cancer, rectal cancer, esophagus cancer, gall bladder cancer, head cancer, eye cancer, neck cancer, kidney cancer, Wilms' tumor, liver cancer, Kaposi's sarcoma, prostate cancer, lung cancer, testicular cancer, Hodgkin's disease, non-Hodgkin's lymphoma, oral cancer, skin cancer, mesothelioma, multiple myeloma, ovarian cancer, endocrine pancreatic cancer, glucagonoma, pancreatic cancer, parathyroid cancer, penis cancer, pituitary cancer, soft tissue sarcoma, retinoblastoma, small intestine cancer, stomach cancer, thymus cancer, thyroid cancer, trophoblastic cancer, hydatidiform mole, uterine cancer, endometrial cancer, vagina cancer, vulva cancer, acoustic neuroma, mycosis fungoides, insulinoma, carcinoid syndrome, somatostatinoma, gum cancer, heart cancer, lip cancer, meninges cancer, mouth cancer, nerve cancer, palate cancer, parotid gland cancer, peritoneum cancer, pharynx cancer, pleural cancer, salivary gland cancer, tongue cancer and tonsil cancer.

Before classifying a human or animal patient as suitable for the therapy of the present invention, the clinician may examine a patient. Based on the results deviating from the normal and revealing a tumor or cancer, the clinician may suggest treatment of the present invention for a patient.

Pharmaceutical Composition

A pharmaceutical composition of the invention comprises at least one type of viral vectors of the invention. Furthermore, the composition may comprise at least two, three or four different vectors. In addition to the vector, a pharmaceutical composition may also comprise other therapeutically effective agents, any other agents such as pharmaceutically acceptable carriers, buffers, excipients, adjuvants, additives, antiseptics, filling, stabilising and/or thickening agents, and/or any components normally found in corresponding products. Selection of suitable ingredients and appropriate manufacturing methods for formulating the compositions belongs to general knowledge of a man skilled in the art.

The pharmaceutical composition may be in any form, such as solid, semisolid or liquid form, suitable for administration. A formulation can be selected from a group consisting of, but not limited to, solutions, emulsions, suspensions, tablets, pellets and capsules. The compositions of the current invention are not limited to a certain formulation, instead the composition can be formulated into any known pharmaceutically acceptable formulation. The pharmaceutical compositions may be produced by any conventional processes known in the art.

In one embodiment of the invention, the viral vector or pharmaceutical composition acts as an in situ vehicle for recruitment of T-cells, enhancing their therapeutic effect and allowing their propagation at the tumor.

A pharmaceutical kit of the present invention comprises an adoptive cell therapeutic composition and oncolytic adenoviral vectors coding for at least one cytokine. The adoptive cell therapeutic composition is formulated in a first formulation and the oncolytic adenoviral vectors coding for at least one cytokine are formulated in a second formulation. In another embodiment of the invention the first and the second formulations are for simultaneous or sequential, in any order, administration to a subject Administration The vector or pharmaceutical composition of the invention may be administered to any eukaryotic subject selected from a group consisting of plants, animals and human beings. In a specific embodiment of the invention, the subject is a human or an animal. An animal may be selected from a group consisting of pets, domestic animals and production animals.

Any conventional method may be used for administration of the vector or composition to a subject. The route of administration depends on the formulation or form of the composition, the disease, location of tumors, the patient, comorbidities and other factors.

In one embodiment of the invention the separate administration(s) of adoptive cell therapeutic composition and oncolytic adenoviral vectors coding for at least one cytokine to a subject is (are) conducted simultaneously or consecutively, in any order. As used herein "separate administration" or "separate" refers to a situation, wherein adoptive cell therapeutic composition and oncolytic adenoviral vectors are two different products or compositions distinct from each other.

Only one administration of adoptive cell therapeutic composition and oncolytic adenoviral vectors coding for at least one cytokine of the invention or only oncolytic or non-cytolytic virus vectors may have therapeutic effects. There may be any period between the administrations depending for example on the patient and type, degree or location of cancer. In one embodiment of the invention there is a time period of one minute to four weeks, specifically 1 to 10 days, more specifically 1 to five days, between the consecutive administration of adoptive cell therapeutic composition and oncolytic adenoviral vectors coding for at least one cytokine and/or there are several administrations of adoptive cell therapeutic composition and oncolytic adenoviral vectors. The numbers of administration times of adoptive cell therapeutic composition and oncolytic adenoviral vectors may also be different during the treatment period. Oncolytic adenoviral vectors or pharmaceutical or adoptive cell compositions may be administered for example from 1 to 10 times in the first 2 weeks, 4 weeks, monthly or during the treatment period. In one embodiment of the invention, administration of vectors or any compositions is done three to seven times in the first 2 weeks, then at 4 weeks and then monthly. In a specific embodiment of the invention, administration is done four times in the first 2 weeks, then at 4 weeks and then monthly. The length of the treatment period may vary, and for example may last from two to 12 months or more.

In a specific embodiment of the invention an adoptive cell therapeutic composition and oncolytic adenoviral vectors are administered on the same day and thereafter oncolytic adenoviral vectors are administered every week, two weeks, three weeks or every month during a treatment period which may last for example from one to 6 or 12 months or more.

In one embodiment of the invention, the administration of oncolytic virus is conducted through an intratumoral, intra-arterial, intravenous, intrapleural, intravesicular, intracavitary or peritoneal injection, or an oral administration. Any combination of administrations is also possible. The approach can give systemic efficacy despite local injection. Adoptive cell therapeutic composition may be administered intravenously or intratumorally. In one embodiment the administration of the adoptive cell therapeutic composition and/or oncolytic viral vectors coding for at least one cytokine is conducted through an intratumoral, intra-arterial, intravenous, intrapleural, intravesicular, intracavitary or peritoneal injection, or an oral administration. In a specific embodiment of the invention TILs or T cells are administered intravenously and viral vectors intratumorally and/or intravenously. Of note, virus is delivered to the tumor separately from administration of T-cells; virus is not used to modify the T-cell graft ex vivo. In essence, the virus modifies the tumor in such a way that the T-cell graft can work better.

The effective dose of vectors depends on at least the subject in need of the treatment, tumor type, location of the tumor and stage of the tumor. The dose may vary for example from about $1\times10^8$ viral particles (VP) to about $1\times10^{14}$ VP, specifically from about $5\times10^9$ VP to about $1\times10^{13}$ VP and more specifically from about $8\times10^9$ VP to about $1\times10^{12}$ VP. In one embodiment oncolytic adenoviral vectors coding for at least one cytokine are administered in an amount of $1\times10^{10}$-$1\times10^{14}$ virus particles. In another embodiment of the invention the dose is in the range of about $5\times10^{10}$-$5\times10^{11}$ VP.

The amount of cells transferred will also depend on the patient, but typical amounts range from $1\times10^9$-$1\times10^{12}$ cells per injection. The number of injections also varies but typical embodiments include 1 or 2 rounds of treatment several (e.g. 2-4) weeks apart.

Any other treatment or combination of treatments may be used in addition to the therapies of the present invention. In a specific embodiment the method or use of the invention further comprises administration of concurrent or sequential radiotherapy, monoclonal antibodies, chemotherapy or other anti-cancer drugs or interventions (including surgery) to a subject.

The terms "treat" or "increase", as well as words stemming therefrom, as used herein, do not necessarily imply 100% or complete treatment or increase. Rather, there are varying degrees of which one of ordinary skill in the art recognizes as having a potential benefit or therapeutic effect. In this respect, the present inventive methods can provide any amount of increase in the efficacy of T-cell therapy or any degree of treatment or prevention of a disease.

FIGS. 28-32, 36 and 48 illustrate the methods and mechanisms of the present invention.

It will be obvious to a person skilled in the art that, as the technology advances, the inventive concept can be implemented in various ways. The invention and its embodiments are not limited to the examples described above but may vary within the scope of the claims.

EXAMPLES

Materials & Methods

B16-OVA Animal Model:

ovalbumin-expressing B16 cells (B16-OVA) were maintained in RPMI, 10% FBS, 5 mg/ml G418, 20 mM L-Glutamine, 1× Pen/Strep solution (GIBCO). 4-7-week-old C57BL/6 immunocompetent female mice were implanted subcutaneously with $2.5 \times 10^5$ B16-OVA cells in 50 ul RPMI, 0% FBS, in the right flank, one tumor per mouse. Roughly ten days post tumor implantation (when tumors became injectable, ~3 mm minimum diameter), mice were divided into groups and treated in some experiments on six consecutive days with intratumoral injections of either 50 ul PBS or $1 \times 10^9$ viral particles (VPs) of oncolytic adenovirus in 50 ul PBS. In other experiments, three injections were given on days 0, 2 and 4. As murine cells are non-permissive to human adenovirus, multiple intratumoral virus injections were used to mimic virus replication-induced inflammation, (Blair et al., 1989).

Adoptive Transfer:

On the first day of the i.t. treatment, the mice also received by adoptive transfer in the intraperitoneal cavity $5 \times 10^5$ to $2 \times 10^6$ overnight-rested CD8a-enriched and expanded splenocytes from 4-8-week-old C57BL/6-Tg(TcraTcrb) 1100Mjb/J (OT-1) mice, genetically engineered to have only ovalbumin (OVA)-specific CD8 T-cell receptors, in 100 ul RPMI, 0% FBS. CD8a-enrichment was performed by mouse CD8a (Ly-2) MicroBeads 5 days prior to transfer, per manufacturer's instructions (Miltenyi Biotech, USA, cat. no 130-049-401). Enriched cells were expanded in numbers for five days in lymphocyte medium (RPMI, 10% FBS, 20 mM L-Glutamine, 1× Pen/Strep solution, 15 mM HEPES, 50 µM 2-mercaptoethanol, 1 mM Na pyruvate) in the presence of recombinant murine IL-2 (160 ng/ml) and soluble anti-mouse CD3ε antibody (0.3 ug/ml, Abcam, clone 145-2C11).

Tissue Processing for Flow Cytometry:

Mice were euthanized and spleens, draining lymph nodes and tumors were harvested in 1 to 10 ml RPMI, 10% FBS, and blood was collected by terminal heart bleed into the pleural cavity and transferred by disposable syringe into EDTA-containing microcentrifuge tubes, and processed for analysis: solid tissues were roughly dissociated by scalpel and triturated in a 10 ml disposable sterile pipette tip in 5 to 10 ml ACK lysing buffer (150 mM $NH_4Cl$, 10 mM $KHCO_3$, 0.1 mM EDTA, pH 7.2) and incubated at room temperature (RT) for ~20 minutes, upon which cells were pelleted at 1200 rpm 5 min+4° C., following which cells were re-suspended in 1 to 10 ml RPMI, 10% FBS, depending on the estimated amount of cells, and passed through a 40 µm sterile filter to create a single-cell solution. In some experiments, tumor tissue was instead processed directly after scalpel cutting (before addition of ACK) in 1 ml total volume of protease-coctail (RPMI supplemented with collagenase type A, H or P, Roche, at 1 mg/ml and benzonase, 125 units/ml final conc., Sigma, E1014-25KU) for 1-2 hours at 37° C., 5% $CO_2$, after which 10 ml ACK lysing buffer was added and cells were treated as above. 200 µl whole blood was pipetted into 5 ml ACK lysing buffer and treated as above. Cells were either incubated overnight at 37° C., 5% $CO_2$, or analyzed directly by immunostaining and flow cytometry.

Tissue Processing for Cytokine Analysis:

Mice were euthanized and ~2-10 $mm^3$ tumor pieces were frozen in 2 ml microcentrifuge tubes on dry ice and stored at −80° C. Tumor pieces were weighed and 200 µl ice-cold PBS added. Pieces were homogenized by Tissue Master 125 rotor, 1× protease inhibitor cocktail (Sigma) and 0.1% BSA final conc. was added and tubes were kept on ice. Tumor homogenate was spun at 2000 rpm 10 min+4° C. and the supernatant was analyzed with CBA Flex Set cytokine beads (BD, USA) on BD FACSArray, per manufacturer's instructions.

EXPERIMENTS SUPPORTING THE INVENTION

Experiment 1

Cytokines and Chemokines Induced by Intratumoral Adenovirus Injection

To study whether adenovirus infection could result in cytokine and chemokine expression, we injected mice harboring subcutaneous B16-OVA tumors intratumorally with either PBS or 5/3 chimeric oncolytic adenovirus on days 0, 1, 2, 3, 4 and 5. Tumors from three mice per treatment group were extracted and processed for cytokine analysis on day 0 (before virus injection=baseline control), and from three other mice per time point on days 6, 10, 14 and 18.

Figure 1:
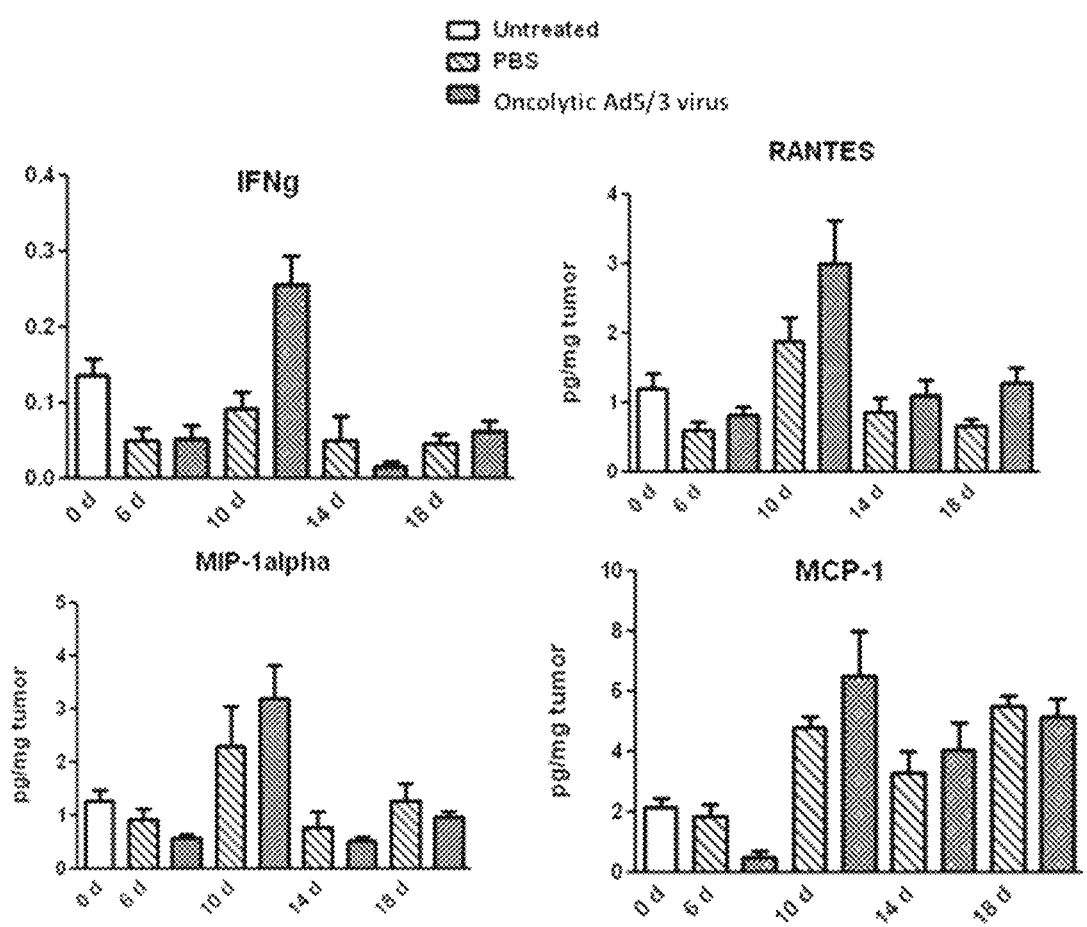
FIG. 1 shows that treatment with Ad5/3 chimeric oncolytic adenovirus increased cytokine and chemokine secretion in B16-OVA tumors. Interferon-γ can upregulate the expression of HLA (=MHC) class I, thus generating a tumor cell phenotype that can effectively be recognized by TILs. Various IFN-γ inducible chemokines (such as RANTES, MIP-1α and MCP-1) are involved in immune cell recruitment, which might promote TIL activation and proliferation. Also trafficking of TILs can be enhanced by up-regulation of these chemokines.

Remarkably, the results showed a virus-induced increase in secretion of IFN-γ and subsequent up-regulation of IFN-γ inducible chemokines RANTES, MIP-1α and MCP-1 on day 10 (FIG. 1).

For enhancing therapeutic efficacy of adoptive cell therapy, these findings are important Based on this data, treatment with oncolytic cytokine-armed adenovirus results in favorable alteration of tumor microenvironment, increased chemotaxis of adoptively transferred immune cells and enhanced tumor cell recognition by cytotoxic CD8+ T-cells.

Experiment 2

Adenovirus-Mediated Enhancement of Adoptive T Cell Therapy

Figure 2:
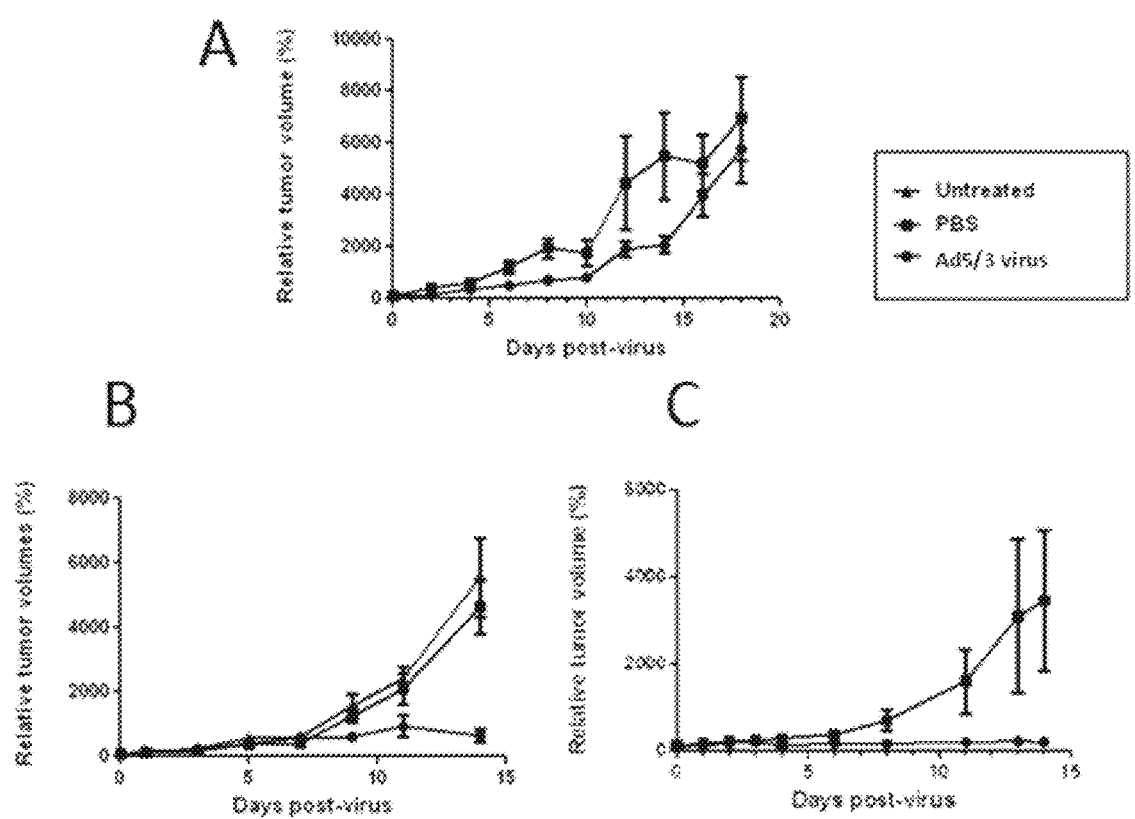
FIG. 2 shows tumor growth control following multiple injections of 5/3 chimeric oncolytic adenovirus with or without adoptive cell transfer. Adenovirus treatment alone (A) had little effect on B16-OVA tumor growth compared to PBS treatment. Adoptive transfer of 500 000 (B) or 2 000 000 (C) tumor-specific OT-I lymphocytes in combination with virus injections resulted in significant tumor growth control. The poor therapeutic effect on tumor growth using adenovirus alone or OT-I cells in combination with PBS highlights the major shortcomings of oncolytic virus and adoptive cell transfer therapies used as single agents, supporting the purpose of the invention to enhance efficacy of adoptive cell therapy using adenovirus.

To study the impact of adenovirus treatment on adoptive T cell therapy, murine B16-OVA melanoma tumors were treated with 5/3 chimeric oncolytic adenovirus alone or in combination with adoptive transfer of tumor-specific OT-I cells and compared to mice receiving intratumoral PBS injections. The results of three independent experiments summarized in FIG. 2 reveal, on one hand, that virus injections on their own (keeping in mind that human adenovirus does not productively replicate in mouse cells) resulted in minor tumor growth control, lasting until day 14 post-treatment and diminishing after that (FIG. 2A). On the other hand, when treated mice were adoptively transferred with $5 \times 10^5$ or $2 \times 10^6$ OT-I cells, statistically significant differences between PBS and Ad groups were obtained in two separate experiments (FIGS. 2B and 2C, respectively).

Thus, the presence of virus in the tumor had a strong enhancing effect on adoptive cell therapy. Six intratumoral virus injections at $1 \times 10^9$ VPs each in our hands gave in combination with adoptive transfer of OT-I cells equal or superior anti-tumor efficacy compared to what was reported by Song et al. (2011, Mol Ther) for a single intramuscular injection of $1 \times 10^{10}$ VP of OVA-expressing replication-defective adenovirus (Ad-OVA) admixed with an equal amount of adenovirus co-expressing an A20-specific short-hairpin RNA and a secretory form of flagellin that stimulates toll-like receptor 5 (Ad-shAF) in the B16.OVA melanoma model (Song XT et al. Mol Ther. 2011 January; 19(1):211-7, PMID: 20959814). In light of these results, a novel aspect of our invention is to target the virus injection into the tumor, where we can achieve even with unarmed virus superior tumor control to multi-immune-functional armed virus administered intramuscularly.

Experiment 3

Figure 3:
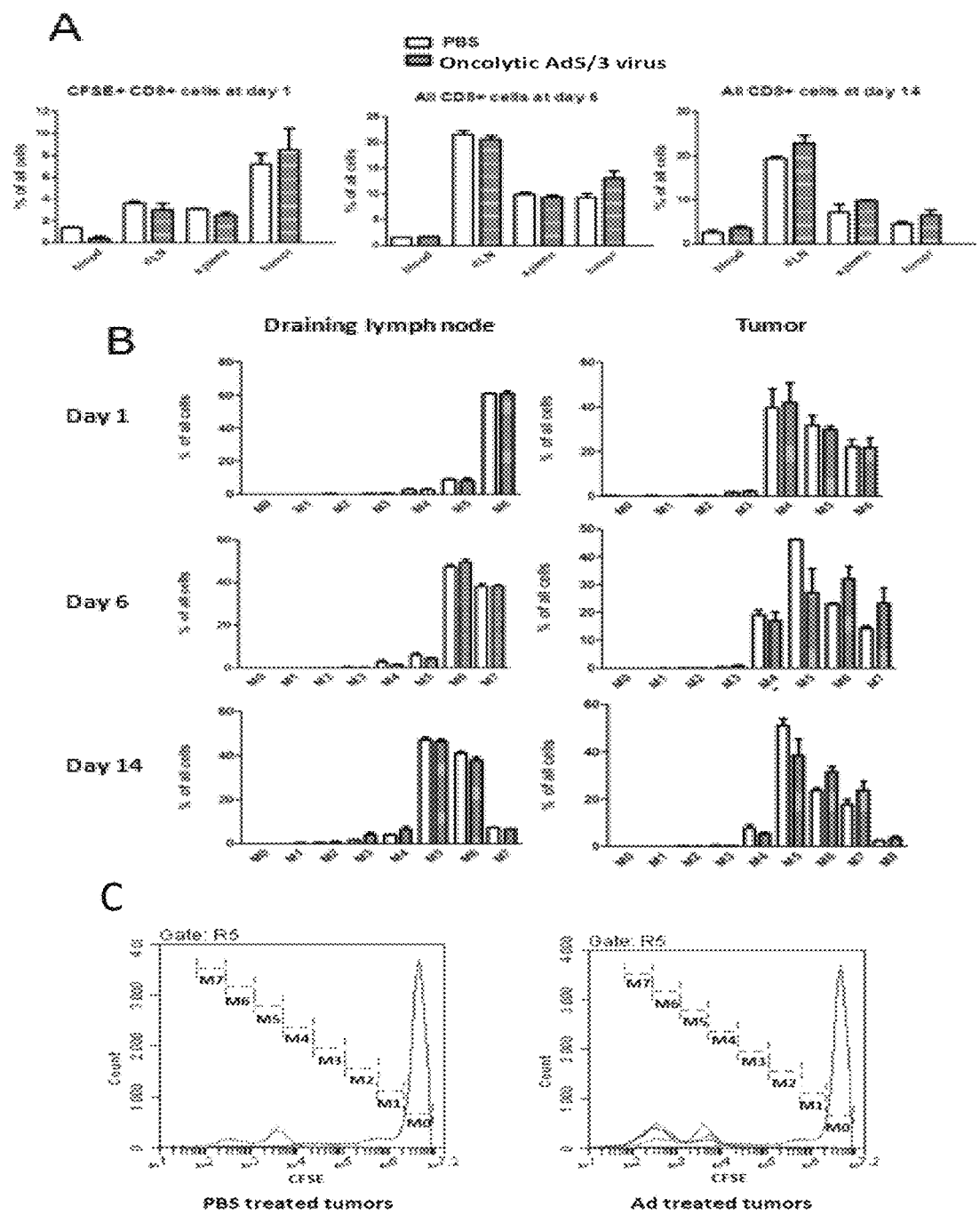
FIG. 3 shows that adenovirus injections induce T cell trafficking into tumors, and increase proliferation of adoptively transferred T cells in tumors. A) Amount of adoptively transferred CD8+CFSE+ cells increased in tumors and decreased in blood, draining lymph nodes and spleen of Ad treated mice at day 1 post-treatment, purportedly due to lymphocyte trafficking. The overall CD8+ T-cell count remained high in the adenovirus treated tumors throughout the experiment, suggesting resistance of these cells to the deleterious tumor microenvironment and/or increased proliferation of the CD8+ T cells. B) On days 6 and 14 the OT-I cell proliferation was enhanced in the Ad treated tumors when compared to the PBS group, seen as a greater fraction of cells that have undergone cell division (moved toward M7) than in the PBS group. Consequently, treatment with oncolytic adenovirus induces trafficking and proliferation of adoptively transferred TILs. C) Example on how gating of CFSE-positive cells was done. M0 indicates cells that have not divided, M7 shows cells that have divided enough to dilute CFSE to below detectable limits (more than 7 times).

Adenovirus-Mediated Alterations in Quality and Quantity of Immune Cell Populations In Vivo To study the trafficking and proliferation of adoptively transferred cells of experiment 2, OT-I cells were stained ex vivo with 5 μM carboxyfluorescein succinimidyl ester (CFSE). This fluorescent cell staining dye is diluted with every cell division and therefore enables us to trace lymphocyte proliferation by flow cytometry by analyzing ~½ fractional reduction of fluorescence signal intensity at each cell division (up to 7 divisions, here labeled M0-7). On day 1 post-transfer the results showed virus-induced accumulation of transferred OT-I cells (CD8+CFSE+ double positive population) in the tumors, concomitant with reduction of these cells in the blood (FIG. 3A). At later time points, also the total CD8+ T-cell count appeared higher in the virus-treated tumors compared to PBS-injected tumors, and on day 14 the overall CD8+ T-cell count was increased in lymphoid organs of virus treated mice.

The amounts of OT-I cell divisions at different time points are depicted in FIG. 3B. Since the proliferation status of OT-I cells was the same between both groups on day 1, differences in the CD8+ cell count in various organs were due to adenovirus-induced immune cell trafficking. At later time points, however, the situation had changed and the increase of OT-I cells in the adenovirus treated tumor was due to increased lymphocyte proliferation. On day 6 the majority of OT-I cells in PBS treated tumors were arrested in M5 phase, whereas transferred cells in adenovirus group continued to proliferate (divisions M6-M7). This data suggests that oncolytic virotherapy or non-cytolytic virus infection results in enhanced trafficking and proliferation of adoptively transferred lymphocytes through breaking the immune suppression in the tumors, attracting immune cells that contribute to CD8+ cell activation and/or through some other important mechanisms that help overcome T-cell anergy.

Figure 4:
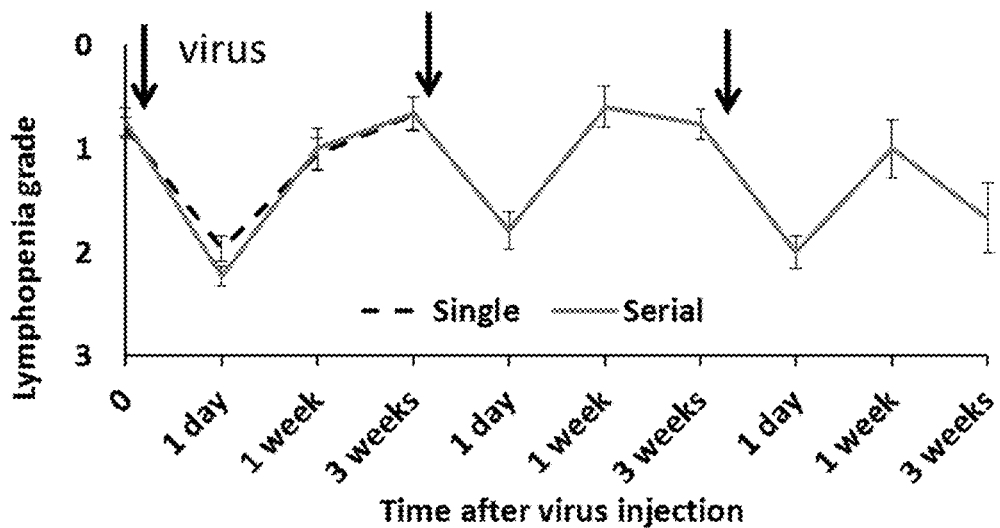
FIG. 4 reveals data from humans treated with oncolytic adenovirus on days indicated by arrows. Virus injection into tumor resulted in a decrease of lymphocytes in blood, reflecting their trafficking to tumors.

As support to our findings in animal models, we have observed transient depression of blood lymphocyte counts during the first day following oncolytic virus administration to patients with advanced cancer (FIG. 4), suggesting mobilization of circulating T cells in response to acute adenovirus infection in the tumor.

Figure 5:
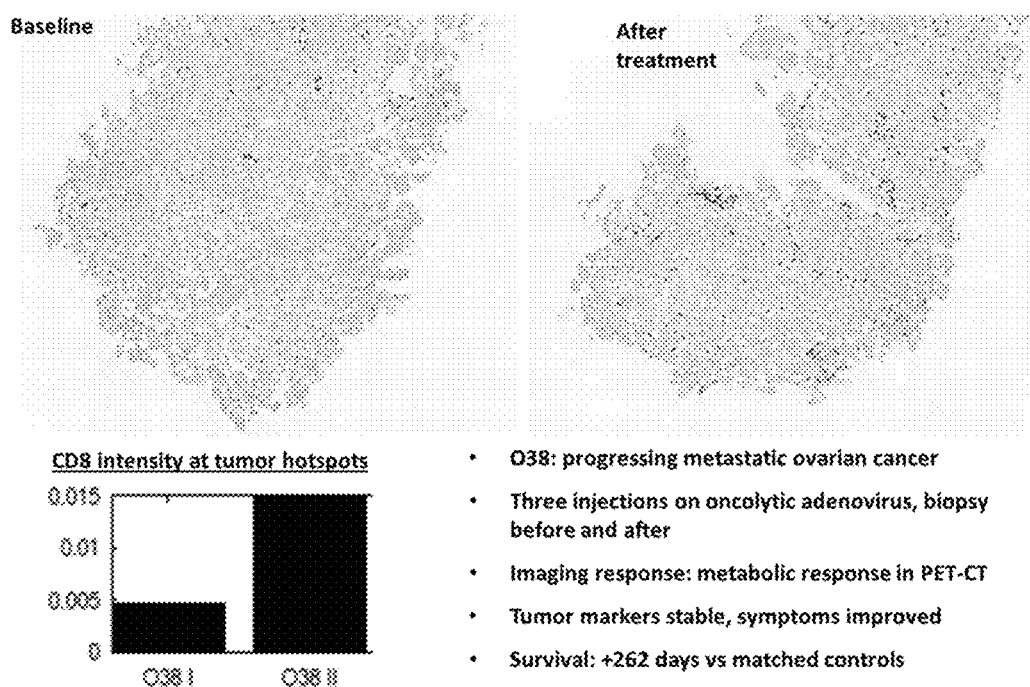
FIG. 5 reveals data that oncolytic adenovirus injection into a tumor of a human cancer patient caused influx of CD8+ T cells. Intratumoral injection of oncolytic adenovirus results in accumulation of CD8+ T-cells at the tumor assessed from needle biopsies before and after treatment.

Furthermore, in support of adenovirus infection recruiting T cells into tumors, we detected increased numbers of CD8+ T cells in tumor biopsy tissue sections after treatment than before (FIG. 5).

FIG. 6 shows results of adenovirus injections combined with adoptive transfer of T cells.

Figure 7:
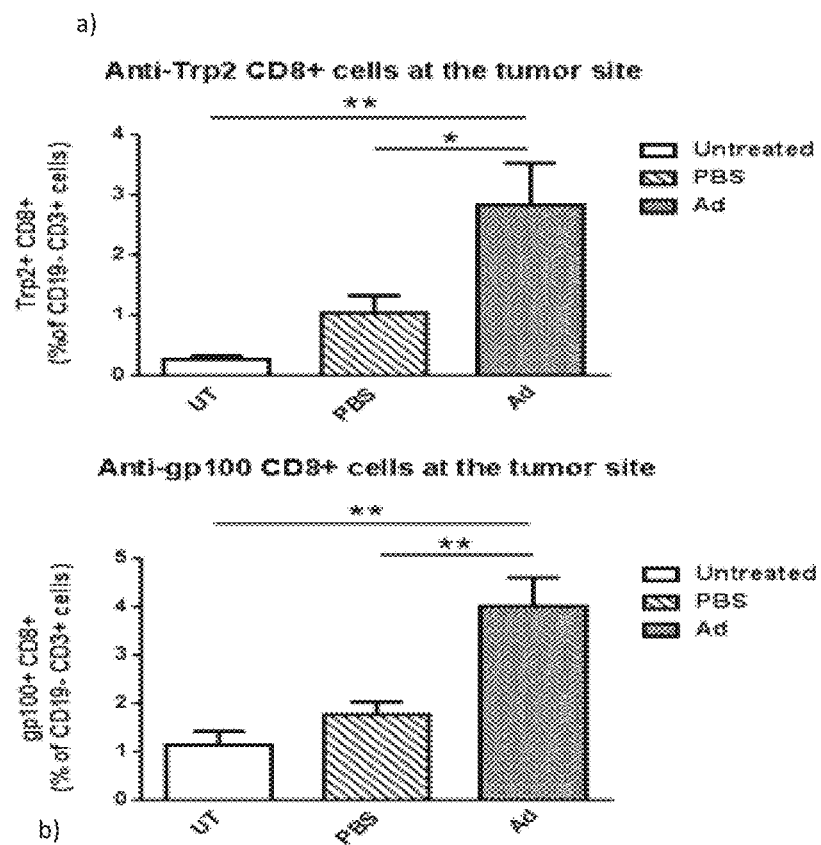
FIG. 7 reveals dramatic increase in the number of "natural" anti-tumor T-cells due to adoptive transfer and virus injection. Mice with subcutaneous B16-Ova tumors were adoptively transferred with 5×10$^5$ OT1 lymphocytes intraperitoneally and tumors were left untreated, or injected with PBS or Ad5/3 (see Examples Materials and methods). Adoptive transfer+virus injections acts act as catalyst for propagation of "other" T-cells at tumor and local lymph nodes. (a) Trp2 CD8+ cells at the tumor site. (b) Anti-gp100 CD8+ cell at the tumor site.

FIG. 7 reveals dramatic increase in the number of "natural" anti-tumor T-cells due to adoptive transfer and virus injection.

Figure 8:
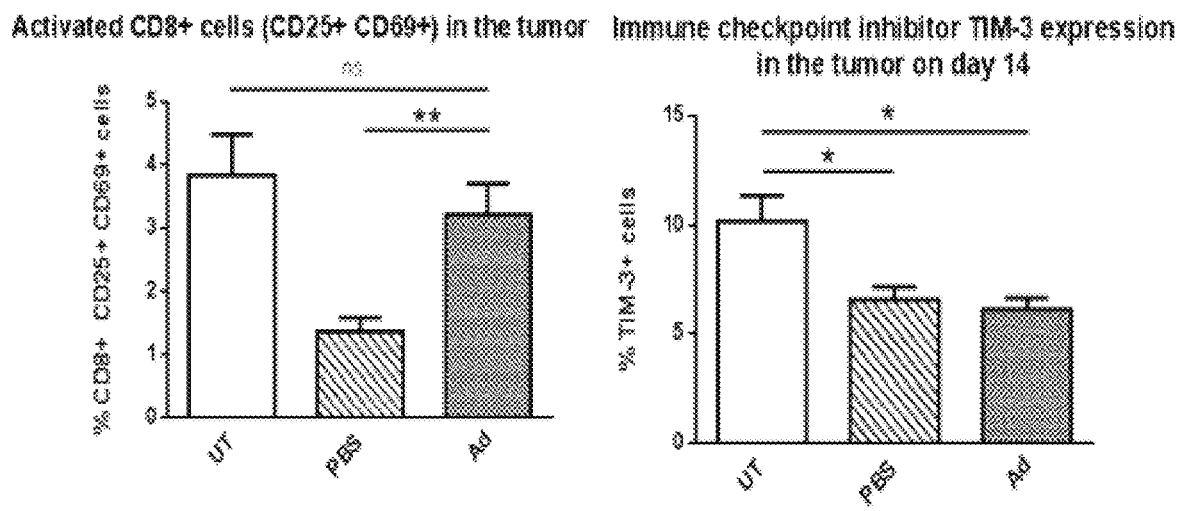
FIG. 8 shows activated CD8+ cells in tumor and TIM-3 expression in the tumor on day 14. Mice with subcutaneous B16-Ova tumors were adoptively transferred with 5×10$^5$ OT1 lymphocytes intraperitoneally and tumors were left untreated, or injected with PBS or Ad5/3 (see Examples Materials and methods). Immunosuppression in immunotherapy: increase in T-cell number is not enough if immunosuppression is not removed. There are more activated T-cells in virus treated tumors and less immunosuppression.

FIG. 8 shows activated CD8+ cells in tumor and TIM-3 expression in the tumor on day 14.

FIG. 9 shows that increase in anti-tumor T-cells and reduction of immunosuppression results in systemic immunity against tumor antigens.

FIG. 10 shows distribution of OTI T-cells following virus injection.

Figure 11:
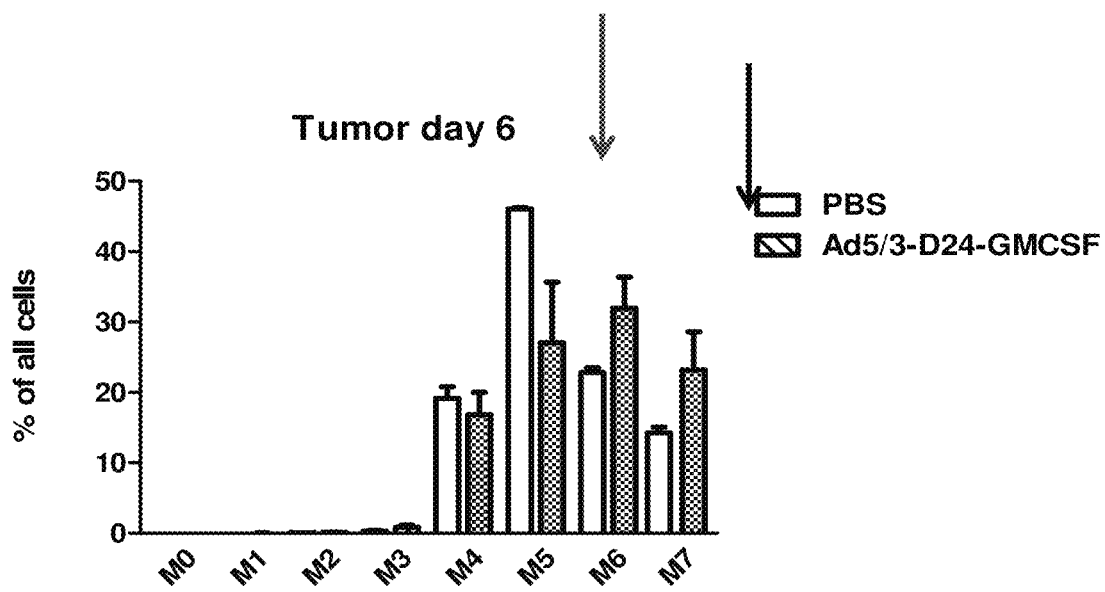
FIG. 11 reveals that lifting immunosuppression can induce propagation of cells. Adenovirus treated tumors contained more tumor specific lymphocytes (OT-I cells). In PBS treated tumors OTI cells had arrested in M5 phase (left arrow), while in the Ad group they continued to proliferate (right arrow).

FIG. 11 reveals that lifting immunosuppression can induce propagation of cells.

Figure 12:
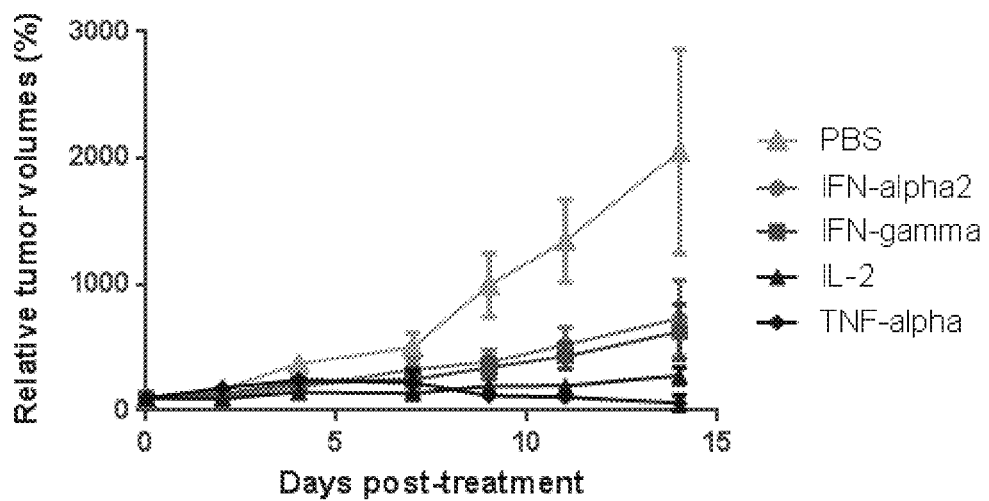
FIG. 12 shows efficacy of recombinant cytokines (no virus) in combination with OT1 cells.

FIG. 12 shows efficacy of recombinant cytokines (no virus) in combination with OT1 cells.

Experiment 4

Adoptively Transferred T-Cells+Murine Cytokine-Armed Ad5 Adenovirus

Model:
C57BL/6 with B16-OVA (0.25×10e6 cells per animal)
Groups:
No injection
Ad5-Luc
Ad5-CMV-mTNFa
Ad5-CMV-mIFNg
Ad5-CMV-mIL2
Ad5-CMV-mIFNb1
No injection+OT1
Ad5-Luc+OT1
Ad5-CMV-mTNFa+OT1
Ad5-CMV-mIFNg+OT1
Ad5-CMV-mIL2+OT1
Ad5-CMV-mIFNb1+OT1

Ad5 vector is a vector of non-replicative human adenovirus coding for a mouse transgene. The constructs were made with AdEasy technology (Agilent Inc); the transgene cassette (driven by a CMV promoter) is in the deleted E1 region (see e.g. Diaconu I et al. Cancer Res. 2012 May 1; 72(9):2327-38).

Group Size:
n=7, 12×7=84 (+extra 20%=100)
Treatment Schedule:
OT1 cells: 2×10e6 per animal i.p. on Day 1
Virus injections: 1×10e9 virus particles (OD260) on Day 1 and weekly thereafter
Endpoint:
Tumor volume (measured every 2 days for the first week and then every 3 days)
Collection of tumors and spleens when mice die or are killed; for FACS and/or ELISPOT (focus on assays most relevant according to Siri data).

Figure 13:
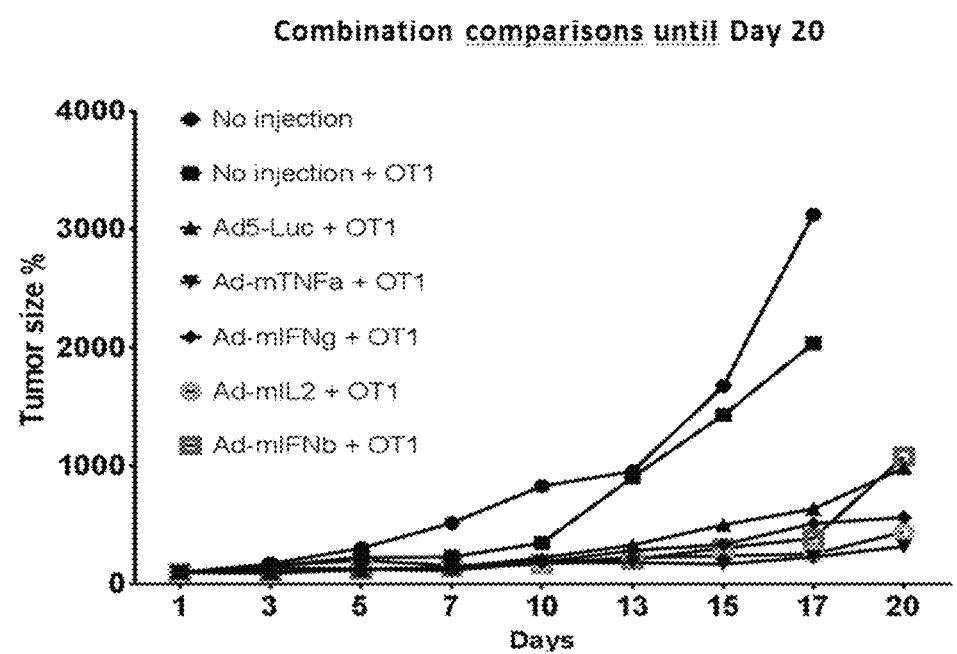
FIG. 13 shows antitumor efficacy of cytokine-armed adenoviruses combined with adoptive T-cell transfer. C57BL/6 mice bearing subcutaneous B16-OVA melanoma tumors were treated with 1.5×10e6 CD8+ enriched OT-1

The best transgenes in combination with T-cell therapy were TNFalpha ja IL2 (FIG. 13). Strengthening the data, the same cytokines were implicated in the experiment without virus.

FIG. 14 shows the results of different viruses (without T-cell therapy) on tumor size (FIG. 14).

FIG. 15 shows the excellent results of T-cell therapy in combination with Ad5-CMV-mTNFalpha-vector.

FIG. 16 shows the excellent results of T-cell therapy in combination with Ad5-CMV-mIL2-vector.

Novel Virus Constructs

The following new virus constructs are presented as examples of our proposed technology:
C5a and TNF-α Expressing Oncolytic Viruses We generated new oncolytic Ad5/3 adenoviruses carrying the active portion of complement component C5a or human TNF-α as transgenes instead of 6.7K/gp19 gene regions (FIG. 17).

Experiment 5

Transgene Expression from C5a-Encoding Adenovirus Vector

In order to confirm—as proof-of-concept—that oncolytic adenoviruses are able to express the chosen cytokines proposed to augment adoptive cell therapy, we infected human A549 cells in culture at 10 VP/cell of adenovirus encoding C5a (FIG. 24), and assessed C5a levels in cell culture supernatant at different time points post infection by ELISA. Results indeed validate the assumption and support the generation of proprietary adenovirus constructs harboring selected cytokines.

Experiment 6

Effect on Monocyte Migration by Novel Adenovirus Vectors

We tested the C5a capability of recruiting monocytes using an in vitro chemotaxis assay: A549 cells were infected either with adenovirus expressing C5a or with unarmed control virus (10 VP/cell—infectious units between viruses similar), or were treated with PBS, and media was collected 48 h post infection and was used to recruit human monocytic cell line THP1 in a transwell chemotaxis assay per manufacturer's instructions (Millipore QCM, cat. no. ECM512). Results reveal significantly greater attraction of monocytes by supernatant from C5a-expressing virus-infected cells than by medium from non-infected cells or cells infected with unarmed control virus (FIG. 25).

Experiment 7

Anti-Tumor Efficacy of C5a-Armed Adenovirus

To assess the anti-tumor potency of C5a in the context of non-cytolytic tumor infection, we treated established B16-OVA tumors in C57BL/6 mice on days 0, 2 and 4 with either PBS, C5a-expressing- or with unarmed control viruses. Results reveal strong anti-tumor effect by the C5a-expressing virus (FIG. 26).

Experiment 8

Increased Anti-Tumor T Cell Expansion by C5a-Virus

To assess whether the observed increase in anti-tumor efficacy of C5a-expressing virus (FIG. 24) was related to T cells, tumors were analyzed by flow cytometry for ovalbumin-specific CD8+ T cells, detected by staining with APC-conjugated pentamer specific for TCR recognizing MHC I loaded with immunodominant ovalbumin peptide SIINFEKL (ProImmune, USA). Indeed, tumors in the C5a-virus group contained a significantly greater fraction of tumor-specific CD8 T cells than tumors injected with control virus or PBS (FIG. 27).

Experiment 9

Transgene Expression from TNF-Encoding Adenovirus

Similar to the C5a virus (FIG. 24 and Experiment 5), we tested the ability of hTNF-α-expressing oncolytic adenovirus to mediate secretion of the transgene of choice. Results confirm expression (FIG. 18).

Experiment 10

Biological Effect of Expressed Transgene is Retained in Oncolytic Adenovirus

In order to assess whether the adenovirus-expressed transgene retains its biological effects, virus-free (100 kD-filtered) supernatant from A549 cells infected with control unarmed virus or with TNF-alpha-expressing virus (varying VPs/cell, 72 h p.i.) was applied onto WEHI-13VAR (ATCC CRL-2148) cells, which are sensitive to TNF-alpha, and these cells were assessed for viability 72 hours after exposure to the supernatant. (For example Espevik T et al. J Immunol Methods. 1986; 95(1): 99-105 describes the method.) Results reveal that TNF-alpha expressed from oncolytic adenovirus retains potent biological effects (FIG. 19).

Experiment 11

Oncolytic Cytokine-Expressing Viruses Retain Cell-Killing Ability In Vitro

Because TNF-alpha may have antiviral effects, it was important to confirm that oncolytic effect of adenovirus expressing TNF-α retains its ability to infect and kill cancer cells. Several cancer cell lines in culture were infected with TNF-alpha-expressing or with control viruses and assessed for viability by CelltiterGlo AQ MTS assay, as per manufacturer's instructions (Promega, USA). Results show the virus is oncolytic in vitro (FIGS. 19-20).

Experiment 12

Synergy Between Radiotherapy and Oncolytic Virus Expressing TNF Alpha

We treated nude mice carrying subcutaneous A549 xenografts intratumorally with viruses with or without concomitant focused external beam radiation (XRT) (FIG. 21). RD indicates replication deficient virus and unarmed virus is an oncolytic virus without TNFalpha.

Experiment 13

Increased Anti-Tumor Efficacy of TNF-Alpha-Expressing Adenovirus in Immunocompetent Hosts To test whether oncolytic adenovirus, which does not replicate in murine cells, might still be able to cause anti-tumor effects in vivo in immunocompetent mice, mice with established B16.OVA tumors were injected intratumorally with TNF-alpha-expressing or unarmed control virus or PBS, in a manner similar to as in FIG. 26. Results show greater overall tumor control with TNF-alpha-expressing virus compared to controls (FIG. 22), suggesting that human TNF-alpha is partially active in mice and supporting the notion of arming viruses to achieve greater anti-tumor effects.

Experiment 14

Increased Anti-Tumor T Cell Expansion by TNFα-Virus

Similar to Experiment 11, we wanted to test whether the observed anti-tumor effect of the TNF-alpha-expressing virus was associated with induction of tumor-specific cytolytic T cell responses. We extracted tumors and processed them for flow cytometric analysis, as in Experiment 11. Results (FIG. 23) indeed confirm that also TNF-alpha expression facilitates expansion of tumor-specific T cells at the tumor site, strongly arguing in favor of the proposed technology.

FIGS. 28-32, 36 and 48 illustrate the methods and mechanisms of the present invention.

Experiment 15

Combination Experiment with Two Different Adenoviral Vectors and OT1 (Ad-mTNFa/Ad-mIL2+OT1)

Model:
C57BL/6 with B16-OVA (0.25×10e6 cells per animal)
Groups:
Ad5-CMV-mTNFa (1×10e9 VP)
Ad5-CMV-mIL2 (1×10e9 VP)
Ad5-CMV-mTNFa+Ad5-CMV-mIL2 (0.5+0.5×10e9 VP)
Ad5-CMV-mTNFa+OT1
Ad5-CMV-mIL2+OT1
Ad5-CMV-mTNFa+Ad5-CMV-mIL2+OT1
Ad5Luc1+OT1
No injection (mock-mock)
Ad5 vector is a vector of non-replicative human adenovirus coding for a mouse transgene. The constructs were made with AdEasy technology (Agilent Inc); the transgene cassette (driven by a CMV promoter) is in the deleted E1 region (see e.g. Diaconu I et al. Cancer Res. 2012 May 1; 72(9): 2327-38).
Group Size:
n=9
100 ordered
Treatment Schedule:
OT1 cells: 1.5×10e6 per animal i.p. on Day 1 (same amount as in previous experiment, not 2×10e6)
Virus injections: for single agents: 1×10e9 virus particles (OD260) on Day 1 and weekly thereafter; for combination: 0.5×10e9 VP+0.5×10e9 VP on Day 1 and weekly thereafter
Endpoint: Tumor volume (measured every 2 days for the first week and then every 3 days)

Further Experiments Supporting the Invention

Several animal experiments support the invention. First we screened optimal cytokine candidates to combine with adoptive T-cell transfer using recombinant murine forms of cytokines (FIG. 49). A cytokine(s) is(are) selected from the following group: interferon alpha, interferon beta, interferon gamma, complement C5a, GMCSF, IL-2, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5, CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2. A schematic of the general layout of the virus genome comprising the cytokine transgene or two transgenes are shown in FIGS. 33 and 34. FIG. 35 shows nucleotide and amino acid sequences of 2A. Nucleotide sequences of the viral vectors comprising transgenes C5a, hCD40L, hIFNa2, hIFNb1, hIFNg1, hIL2 or TNFa are shown in SEQ ID NOs 1-7, respectively (Ad5/3-E2F-D24-transgene). Furthermore, nucleotide sequences of the viral vectors comprising two transgenes, the other one being IL-2 and the other one C5a, CD40L, IFNa2, IFNb, IFNg, GMCSF or TNFa, are shown in SEQ ID NOs 8-21 (SEQ ID NO: 8 C5a-2A-IL2, SEQ ID NO: 9 IFNa-2A-IL2, SEQ ID NO: 10 TNFa-2A-IL2, SEQ ID NO: 11 CD40L-2A-IL2, SEQ ID NO: 12 IFNb-2A-IL2, SEQ ID NO: 13 GMCSF-2A-IL2, SEQ ID NO: 14 IFNg-2A-IL2, SEQ ID NO: 15 C5a-IRES-IL2, SEQ ID NO: 16 IFNa-IRES-IL2, SEQ ID NO: 17 TNFa-IRES-IL2, SEQ ID NO: 18 CD40L-IRES-IL2, SEQ ID NO: 19 IFNb-IRES-IL2, SEQ ID NO: 20 GMCSF-IRES-IL2, SEQ ID NO: 21 IFNg-IRES-IL2) (Ad5/3-E2F-D24-transgene-IRES/2A-transgene).

Several of the best candidates were chosen for a cytokine/virus combination experiment, where regimen roughly stay the same and all the mice receive intraperitoneal injection of CD8a+ enriched OT-I lymphocytes and intratumoral treatments of chosen cytokine mixed with adenovirus. In addition, a separate trafficking experiment was conducted using our existing replication deficient adenoviruses coding for either mouse cytokines or human cytokines with proven activity in mice (FIG. 50). RD indicates replication deficient virus. Based on these experiments a final cytokine candidate or candidates can be chosen and analyzed further, even in the clinic.

Results of the experiments indicate that a) virus injection into tumors results in enhanced trafficking of T-cell to the tumor, b) virus injection results in enhanced MHC1 expression in tumors, c) danger signaling is activated resulting in less tolerance and immunosuppression, d) T-cells propagate at the tumor following virus injections. Importantly, adding a cytokine as a transgene enhanced each of these effects. Of note, dual transgenes enhanced the effect further. Thus, intratumoral injection of cytokine armed oncolytic adenovirus enhanced the effect of adoptive cell transfer in a synergistic manner, over what could be achieved with either virus vectors or adoptive cell transfer alone.

To study T cell trafficking and biodistribution after adoptive transfer, a SPECT/CT imaging experiment was conducted (FIG. 51). CD8a+ enriched OT-I lymphocytes were radiolabeled with 111 In and adoptively transferred into recipient mice.

Since the half-life of indium oxine is relatively short (2.83 days), the maximum surveillance period for the imaging was limited to 7 days. Due to this restriction, cells were labeled in two batches and transferred into mice at two different time points. The imaging data from the first batch covers trafficking events from days 0-7, whereas the second batch enables us to observe events in tumors during days 8-14 post-virus.

Oncolytic Ad3 Viruses (FIGS. 37-40, SEQ ID NOs 30 and 31 (Ad3-hTERT-E3del-CMV-CD40L and Ad3-hTERT-E3del-E2F-CD40L))
Cloning Strategy:
1. Construction of Ad3 3'end plasmid containing corresponding expression cassette, this plasmid contains 3'ITR of Ad3 genome, the E3 region from 29,892 to 30,947 of the Ad3 genome were replaced by the expression cassette. (Note: We take advantage of EcoRI restriction site in the Ad3 genome close to 3'end)
2. Construction of Ad3 5'end plasmid, this plasmid contains 5'ITR and hTERT-E1. (Note: We take advantage of unique restriction site NotI in Ad3 genome and NheI restriction site close to 5'end)

3. Construction of pWEA-Ad3-hTERT-CMV-CD40L and pWEA-Ad3-hTERT-E2F-CD40L (Note: We take advantage of phage packaging system)

Construction of Ad3 3'End Plasmid Containing Corresponding Expression Cassette:
1. PCR amplify E2F promoter, forward primer: 5' AAAttaattaatggtaccatccggacaaagc3' (SEQ ID NO: 22), reverse primer 5' TTTgctagcggcgagggctcgatcc3' (SEQ ID NO: 23). Cloned into TA vector pGEM-T (promega) →pGemT-E2F
2. PCR amplify CD40L fragment, forward primer: 5' TAGCTGCTAGCATGATCGAAACATACAAC3' (SEQ ID NO: 26), reverse primer: 5'GTCAATTTGGGCCCTCAGAGTTTGAGTAAGC-CAA3' (SEQ ID NO: 27). Cloned into pGEM-T→pGemT-CD40L.
3. Our Ad3 3'end plasmid containing CMV-GFP(pWEA-Ad3-3'end-CMVGFP) was digested with NheI/ApaI to remove GFP, pGemT-CD40L was digested with NheI/ApaI→pWEA-Ad3-3'end-CMV-CD40L.
4. The CMV promoter in pWEA-Ad3-3'end-CMV-CD40L was replaced by E2F promoter (pGemT-E2F was digested with PacI/NheI)→pWEA-Ad3-3'end-E2F-CD40L Construction of Ad3 5' End Plasmid Containing hTERT-E1:
1. PCR amplify 5'end of Ad3 genome from pKBS2-hTERT (plasmid from Ad3-hTERT-E1A paper), forward primer 5' gtcagtttaaacttaggccggccctatc-tatataatataccttatagatggaatgg3' (SEQ ID NO: 28), reverse primer 5' CTTCATCAGCAGCTAGCAG-CATAGAATCAG3' (SEQ ID NO: 29). Cloned into pGem-T→pGemT-Ad3-5'end-hTERT.
2. Plasmid pWEA-Ad3 (which contains the whole ad3 genome) was digested with FseI/NotI, the 13.2 kb fragment that contains the 5' end of Ad3 genome was cloned into a vector modified from pBluescript KS(-) (the restriction sites between SacI and XbaI were modified as SacI-PmeI-MluI-FseI-SalI-NotI-XbaI)→pBS-Ad3-5' end
3. Plasmid pBS-Ad3-5' end was digested with PmeI/NheI, the ~800 bp fragment that contains 5'ITR were replaced by the corresponding PmeI/NheI fragment from pGemT-Ad3-5'end-hTERT→pBS-Ad3-5'end-hTERT pWEA-Ad3-hTERT-CMV-CD40L and pWEA-Ad3-hTERT-E2F-CD40L:
1. Plasmid pWEA-Ad3-hTERT-E2F- was digested with EcoRI to remove the 3'end genome, and ligate with the corresponding fragment containing expression cassette from pWEA-Ad3-3'end-CMV-, pWEA-Ad3-3'end-CMV-CD40L and pWEA-Ad3-3'end-E2F-CD40L
2. The ligation were packaged into phages using Gigapack III plus packaging extract (Stratagen) and propagated (X11 blue strain)

The functionality of Ad3 viruses were tested in vitro and the results are shown in FIG. 41. All new viruses were functional and capable of infecting tumour cell lines.

The viruses were also tested on CHO-K7 but they showed no effect on the viability of these cells during the TCID$_{50}$. This was probably due to the lack of human-like desmoglein-2 on the surface of these hamster cells.

In Vivo Results of AD3 Vectors

All animal experiments were approved by the Experimental Animal Committee of the University of Helsinki and the Provincial Government of Southern Finland. Mice were frequently monitored for their health status and euthanized as soon as signs for pain or distress was noticed. Female fox chase severe combined immunodeficiency mice (Charles River) were used.

An orthotopic model of peritoneally disseminated ovarian cancer was developed by injecting 5×10e6 SKOV3-luc cells intraperitoneally in 300 ml of pure Dulbecco's modified Eagle's medium into severe combined immunodeficiency mice (n=5 per group). After 3 days mice were imaged non-invasively and treated intraperitoneally by injecting PBS or 109 VP in PBS per mouse. The mice were imaged on day 3, 7, 14, 21 and 25 using IVIS 100 (Xenogen, Alameda, Calif.) to estimate the number of tumor cells in the mice. For bioluminescence imaging, 150 mg/kg D-luciferin (Promega) was injected intraperitoneally and captured 10 min later with 10 s exposure time, if/stop, medium binning and open filter. During imaging the mice were in isoflurane gas anesthesia. Images were overlaid with Living Image 2.50 (Xenogen). Total flux (photons/s) was measured by drawing regions of interest around the peritoneal area of the mice. Background was subtracted.

FIG. 45 shows anti-tumor efficacy of Ad3 based viruses in vivo.

MTS Cell Proliferation Assay (FIGS. 42-44)

On day one, 105 cells per well (A549, PC3-MM2 or SKOV3-luc) were seeded into 96-well plates in 100 μl of growth medium (GM), which contained 5% of FBS. On day two, the monolayer was washed once with GM containing 5% of FBS. Then the cells were infected with different viruses at doses of 100, 10, 1, 0.1 and 0 virus particles per cell. Thereafter the cells were incubated for one hour on a rocking machine and then washed with GM. After adding new 5% GM the cells were left to the incubator and the GM was replaced every fourth day. The test was terminated by adding mts reagent (Promega) after the cytopathic effect of one of the tested viruses reached 100% with the highest concentration. After two hours of incubation the absorbance was measured at 490 nm filter. The background was then subtracted and results analyzed.

Therapeutic Window of Oncolytic Adenovirus Coding for Murine CD40L in Immunocompetent Mice In immunocompetent animals, viral genomes are present in tumors after i.v. injections (FIG. 46). Albino C57 mice were inoculated s.c. with mouse B16-ova cells and treated intravenously with 5 different viral doses of Ad5 based virus coding for mouse CD40L (see experiments 4 and 15). Tumors of 3 animals per group were collected and stored at −80° C. Total DNA was extracted and viral DNA load was studied with quantitative PCR. Viral E4 copy numbers were normalized to genomic DNA with mouse B-actin primers. In FIG. 46 each icon represents one tumor; horizontal line indicates the median of the group. Mock: n=5; Dose 5: n=4; Dose 4: n=4; Dose 3: n=4; Dose 2: n=6; Dose 1: n=2; Dose 2 i.t.: n=4. DOSE 5: $1\times10^{11}$ VP/mouse; DOSE 4: $3\times10^{10}$ VP/mouse; DOSE 3: $1\times10^{10}$ VP/mouse; DOSE 2: $1\times10^{9}$ VP/mouse; DOSE 1: $1\times10^{8}$ VP/mouse; Positive control (DOSE 2 intratumorally.)

With dose 5.67% of mice had signs of liver toxicity. Dose 4 was able to achieve good tumor transduction following i.v. delivery, without signs of liver toxicity.

Results of the liver enzyme release experiment are shown in FIG. 47. Liver enzyme release experiment was carried out as follows. All animal protocols were reviewed and approved by the Experimental Animal Committee of the University of Helsinki and the Provincial Government of Southern Finland. Three- to four-week-old female albino C57 mice (Harlan Laboratories, The Netherlands) were injected with $2.5\times10^5$ B16-ova cells subcutaneously in both flanks and randomized into 7 groups (3 mice/group). Ad5/3 CMV-mCD40L virus diluted in phosphate buffered saline (PBS) was injected intravenously at $10^8$-$10^{11}$ viral particles (VP)/mouse (dose 1-dose 5). One treatment group received dose 2 ($10^9$ VP/cell) intratumorally as positive control. Animals were anesthetized prior to any procedures and the health status monitored daily. 48 h post virus injection the mice were sacrificed and the blood was collected by cardiac puncture. Serum was separated by centrifuging blood samples at 5000 rpm for 10 minutes. Alanine aminotransferase (ALT) and aspartate aminotransferase (AST) levels (Units/litre) in serum samples were quantified at University of Helsinki Clinical Chemistry Core using the Siemens ADVIA 1650 clinical chemistry analyzer. Hemolytic samples were excluded from the analysis, as serum hemolysis may interfere with the assays (false high ALT and AST levels). The bars show averages+SEM.

REFERENCES

Blair G E, Dixon S C, Griffiths S A, Zajdel M E. Restricted replication of human adenovirus type 5 in mouse cell lines. Virus Res. 1989 December; 14(4):339-46.

Ekkens M J, Shedlock D J, Jung E, Troy A, Pearce E L, Shen H, Pearce E J. Th1 and Th2 cells help CD8 T-cell responses. Infect Immun. 2007 May; 75(5):2291-6.

Kratky W, Reis e Sousa C, Oxenius A, Sporri R. Direct activation of antigen-presenting cells is required for CD8+ T-cell priming and tumor vaccination. Proc Natl Acad Sci USA. 2011 Oct. 18; 108(42):17414-9.

Lugade A A, Sorensen E W, Gerber S A, Moran J P, Frelinger J G, Lord E M. Radiation-induced IFN-gamma production within the tumor microenvironment influences anti-tumor immunity. J Immunol. 2008 Mar. 1; 180(5):3132-9.

Propper D J, Chao D, Braybrooke J P, Bahl P, Thavasu P, Balkwill F, Turley H, Dobbs N, Gatter K, Talbot D C, Harris A L, Ganesan T S. Low-dose IFN-gamma induces tumor MHC expression in metastatic malignant melanoma. Clin Cancer Res. 2003 January; 9(1):84-92.

Schroder K, Hertzog P J, Ravasi T, Hume D A. Interferon-gamma: an overview of signals, mechanisms and functions. J Leukoc Biol. 2004 February; 75(2):163-89.

Street D, Kaufmann A M, Vaughan A, Fisher S G, Hunter M, Schreckenberger C, Potkul R K, Gissmann L, Qiao L. Interferon-gamma enhances susceptibility of cervical cancer cells to lysis by tumor-specific cytotoxic T cells. Gynecol Oncol. 1997 May; 65(2):265-72.

References for Viral Constructs

Blair G E, Dixon S C, Griffiths S A, Zajdel M E. Restricted replication of human adenovirus type 5 in mouse cell lines. Virus Res. 1989 December; 14(4):339-46.

Ekkens M J, Shedlock D J, Jung E, Troy A, Pearce E L, Shen H, Pearce E J. Th1 and Th2 cells help CD8 T-cell responses. Infect Immun. 2007 May; 75(5):2291-6.

Kratky W, Reis e Sousa C, Oxenius A, Sporri R. Direct activation of antigen-presenting cells is required for CD8+ T-cell priming and tumor vaccination. Proc Natl Acad Sci USA. 2011 Oct. 18; 108(42):17414-9.

Lugade A A, Sorensen E W, Gerber S A, Moran J P, Frelinger J G, Lord E M. Radiation-induced IFN-gamma production within the tumor microenvironment influences anti-tumor immunity. J Immunol. 2008 Mar. 1; 180(5):3132-9.

Propper D J, Chao D, Braybrooke J P, Bahl P, Thavasu P, Balkwill F, Turley H, Dobbs N, Gatter K, Talbot D C, Harris A L, Ganesan T S. Low-dose IFN-gamma induces tumor MHC expression in metastatic malignant melanoma. Clin Cancer Res. 2003 January; 9(1):84-92.

Schroder K, Hertzog P J, Ravasi T, Hume D A. Interferon-gamma: an overview of signals, mechanisms and functions. J Leukoc Biol. 2004 February; 75(2):163-89.

Street D, Kaufmann A M, Vaughan A, Fisher S G, Hunter M, Schreckenberger C, Potkul R K, Gissmann L, Qiao L. Interferon-gamma enhances susceptibility of cervical cancer cells to lysis by tumor-specific cytotoxic T cells. Gynecol Oncol. 1997 May; 65(2):265-72.

SEQUENCE LISTING (31 sequences)

SEQ ID NO: 1 - DNA, 35355 bp, Adenovirus
  misc_feature (33085)..(33085): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaacctgcatctcctaaggcagaaaatagaagaacaagctgctaagtacaaacatagtgtgccaaagaaatgctgctatgacggagcccgagtgaacttctacgaaacctgtgaggagcgagtggcccgggttaccataggccctctctgcatcagggccttcaacgagtgctgtactattgcgaacaagatccgaaaagaaagcccccataaacctgtccaactgggaaggtagcaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 2 - DNA, 35904 bp, Adenovirus
  misc_feature (33634)..(33634): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttgtcttactcaaactctgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 3 - DNA, 35685 bp, Adenovirus
  misc_feature (33415)..(33415): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 4 - DNA, 35665 bp, Adenovirus
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 5 - DNA, 35619 bp, Adenovirus
  misc_feature (33349)..(33349): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 6 - DNA, 35563 bp, Adenovirus
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 7 - DNA, 35803 bp, Adenovirus
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 8 - DNA, 35874 bp, Adenovirus
  misc_feature (33604)..(33604): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaacctgcatctcctaaggcagaaaatagaagaacaagctgctaagtacaaacatagtgtgccaaagaaatgctgctatgacggagcccgagtgaacttctacgaaacctgtgaggagcgagtggcccgggttaccataggccctctctgcatcagggccttcaacgagtgctgtactattgcgaacaagatccgaaaagaaagcccccataaacctgtccaactgggaaggcagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 9 - DNA, 36204 bp, Adenovirus
  misc_feature (33934)..(33934): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaacagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 10 - DNA, 36339 bp, Adenovirus
  misc_feature (34069)..(34069): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgcagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 11 - DNA, 36423 bp, Adenovirus
  misc_feature (34153)..(34153): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttgtcttactcaaactccagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 12 - DNA, 36201 bp, Adenovirus
  misc_feature (33931)..(33931): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaaccagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 13 - DNA, 36072 bp, Adenovirus
  misc_feature (33802)..(33802): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagcagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 14 - DNA, 36138 bp, Adenovirus
  misc_feature (33868)..(33868): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagcagctgttgaattttgaccttcttaagcttgcgggagacgtcgagtccaaccccgggcccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 15 - DNA, 36405 bp, Adenovirus
  misc_feature (34135)..(34135): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaacctgcatctcctaaggcagaaaatagaagaacaagctgctaagtacaaacatagtgtgccaaagaaatgctgctatgacggagcccgagtgaacttctacgaaacctgtgaggagcgagtggcccgggttaccataggccctctctgcatcagggccttcaacgagtgctgtactattgcgaacaagatccgaaaagaaagcccccataaacctgtccaactgggaaggtaggcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 16 - DNA, 36735 bp, Adenovirus
  misc_feature (34465)..(34465): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 17 - DNA, 36853 bp, Adenovirus
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 18 - DNA, 36954 bp, Adenovirus
  misc_feature (34684)..(34684): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttgtcttactcaaactctgagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 19 - DNA, 36886 bp, Adenovirus
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgaacgtacgatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgcccaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 20 - DNA, 36603 bp, Adenovirus
  misc_feature (34333)..(34333): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 21 - DNA, 36669 bp, Adenovirus
  misc_feature (34399)..(34399): n is a, g, c or t
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactggtaccgcggccgctggtaccatccggacaaagcctgcgcgcgccccgccccgccattggccgtaccgccccgcgccgccgccccatcccgcccctcgccgccgggtccggcgcgttaaagccaataggaaccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccctcgagctagaagcttgttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggatggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaaccctatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactaataaactctaaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcaagtgatattaataaactccccgggcagctcacttaagttcatgtcgctgtccagctgctgagccacaggctgctgtccaacttgcggttgcttaacgggcggcgaaggagaagtccacgcctacatggggggagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgccccgccgggntatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatttggctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgtta

SEQ ID NO: 22 - DNA, 31 bp, Artificial Sequence
  primer
aaattaattaatggtaccatccggacaaagc

SEQ ID NO: 23 - DNA, 25 bp, Artificial Sequence
  primer
tttgctagcggcgagggctcgatcc

SEQ ID NO: 24 - DNA, 28 bp, Artificial Sequence
  primer
tttgctagcatgtggctgcagagcctgc

SEQ ID NO: 25 - DNA, 29 bp, Artificial Sequence
  primer
tttgggccctcactcctggactggctccc

SEQ ID NO: 26 - DNA, 29 bp, Artificial Sequence
  primer
tagctgctagcatgatcgaaacatacaac

SEQ ID NO: 27 - DNA, 34 bp, Artificial Sequence
  primer
gtcaatttgggccctcagagtttgagtaagccaa

SEQ ID NO: 28 - DNA, 56 bp, Artificial Sequence
  primer
gtcagtttaaacttaggccggccctatctatataatataccttatagatggaatgg

SEQ ID NO: 29 - DNA, 30 bp, Artificial Sequence
  primer
cttcatcagcagctagcagcatagaatcag

SEQ ID NO: 30 - DNA, 36661 bp, Adenovirus
ctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttatgtgggaggagttatgttgcaagttattacggtaaatgtgacgtaaaacgaggtgtggtttgaacacggaagtagacagttttcccacgcttactgacaggatatgaggtagttttgggcggatgcaagtgaaaattctccattttcgcgcgaaaactaaatgaggaagtgaatttctgagtcatttcgcggttatgccagggtggagtatttgccgagggccgagtagactttgaccgtttacgtggaggtttcgattaccgtgtttttcacctaaatttccgcgtacggtgtcaaagttctgtgtttttacgtaggtgtcagctgatcgctgatcgctgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcaggcagcgctgcgtcctgctgcgcacgtgggaagccctggccgatgggctcgaatcgtgccagcgagaagagttttctcctccgcgccgcaagtcagttctgcgctttgaaaatgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctatttaataactgttgaatggtagatttatgtttttttcttgcgattttttgtaggtcctgtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaagctactgctagaaaacgcctcggacggagtctctggcctttggagattctggttcggtggtgatctagctaggctagtgtttaggataaaacaggactacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagtttttagatgttgtatgatgggtatgtggccaggggttgtcggcatggaagcagtaacacttatgaatattaggtttaaaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagaggccttatcagatgctgacctgcgctggtggacattgcaatattcttgctaccgtgcatatcgtttcacatgcacgcaaaaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacttgagacccgatcatttggtgcttgcctgcactggagcggagttcggttctagtggtgaagaaactgactaaagtgagtagtggggcaagatgtggatggggactttcaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattatggaagcatcgttgccaattccagttcctctaataacccttcaaccctggctgaggacaagctacttgttctcttggcgcagctcgaggccttaacccaacgcttaggcgaactgtctaagcaggtggcccagttgcgtgagcaaactgagtctgctgttgccacagcaaagtctaaataaagatctcaaatcaataaataaagaaatacttgatataaaacaaatgaatgtttatttgatttttcgcgcgcggtatgccctggaccatcggtctcgatcattgagaacgcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttcagagggggggatcatgtccacctgcggggctataaaaaataccgtttctggagccggggtgattaactgggacgagagcaaattcctaagcagctgagacttgccgcacccagtgggaccgtaaatgaccccaattacgggttgcagatggtagtttagggaacgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgattggcgccctgcatgtcggccaggtagcagtttaccatgagttcgtagttgagcgcctcggccgcgtggcctttggcacggagcttacctttggaagttttatggcaggcggggcagtagatacatttgagggcatacaacttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggtgatgttaagctggacgtactcgcgcgccacacatttccattcaggaaagatggttgtcagttcatccggaactattctgattcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacatcgcccccctctgatgcttgctcgcacatagtcatagagttcatgtgagggggcaagaagacccgggcccagattggtgcggttgggtttttccgccctgtaaacgatctggcgaaagatggcatgggaattggaagagatagtaggtctctggaatatgttaaaatgggcatgaggtaagcctacagagtcccttatgaagtgggcatatgactcttgcagcttggctaccagctcggcggtgatgagtacatccagggcacagtagtcgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgaggaacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttaaggaaggaggaccagaggtccactgccagtgctgtttgtaactggtcccggtactgacgaaaatgctgtccgactgccatcttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcaccttatgaatgagttgtacctgacttcctttgacgagaaatttcagtggaaaattgaggcctggcgcttgtacctcgcgctttactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattaacttgcatgatcttttggagggcgtgagggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttaaaaaactgggagttacgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgggagggtgagacgatgctgctggtgatgaaattaaaataggcagttttgagacggcggatggtggcgaggagcaccaggtctttgggtccggcttgttggatacgcaggcgatgagccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtccacgaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccaatgagaaagtgtggcggtggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggtctgggggaacgtgaacgggttgggtcgcggtgtaccccggttcgagtccaaagctaagcgatcacgctcggatcggccggagccgcggctaacgtggtattggctatcccgtctcgacccagccgacgaatatccagggtacggagtagagtcgtttttgctgctttttcctggacgtgtgccattgccacgtcaagctttagaacgctcagttctcgggccgtgagtggctcgcgcccgtagtctggagaatcagtcgccagggttgcgttgcggtatgccccggttggagcctaagcgcggctcgtatcggccggtttccgcgacaagcgagggtttggcagccccgttatttccaagaccccgccagccgacttctccagtttacgggagcgagcccttttttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccccagcagaacctgttcagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttctgccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcgattccagcgcgacgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggggatcgcgcgaccgtgtctagcttgctgactcccaactcccgcctgctgctgctgctggtatccccctttactgacagcggtagcattgaccgcaactcgtacttgggctacctgcttaacctgtatcgcgaggccataggacagagccaggtggacgagcagacctatcaagaaatcacccaagtgagccgcgccctgggtcaggaagacacgggcagtttggaagccaccctgaacttcttgctaaccaaccggtcacagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattttccccgcctcccggttatacagtttggaagaaggaagggggcgatagaagacactcttccgtgtcgctatccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgctgaggccagagagggaaaagaacttccccaacaatggaatagagagtctggtggataagatgagtagatggaagacctatgcgcaggatcacagagacgagcccaggatcttgggggctacaagcagaccgatccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcggcgatgatacagcccccactggaggctcccttcgtacccccacggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggtgtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgatgatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacagcctaccgcagttggtacctgtcctacaattacggtaaccctgagaaaggaataaggtcttggacactgctcaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcaagcgctctacccagcatcctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagccgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggctgtgtccattcctttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttcagtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcagacgctggtgacgcgcgcagacgagcccccttcatatgaggaggcagtaaagctcggaatgcccactaccaggcctgtagctcacatggctaccggggtgatgaaaccttctcagtcacatcgacccgccaccttggacttgcctcctccccctgcttctgcggcgcctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcagttcgcccgtgcaacagacacctacttcagtatggggaacaaatttagaaaccccacagtggcgcccacccacgatgtgaccaccgaccgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccagaaacgtctaataactctcatgcaaatttgggtcaacaagccatgcctaacagacccaattacattggcttcagggataacttcgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctgaatggcataggaccagggcacacatatcaaggcattaaagttaaaaccgatgacactaatggatgggaaaaagatgctaatgttgctccagctaatgaaataaccataggcaacaacctggctatggaaattaatatccaagctaacctttggagaagttttctgtactctaatgtggctttgtaccttccagatgtttacaagtacacgccacctaacattactttgcccactaacaccaacacctatgagtacatgaacgggcgagtggtatccccatccctggttgattcatacatcaacattggcgccaggtggtctcttgacccaatggacaatgtgaatccattcaaccaccaccgcaatgctggtctgcgctacaggtccatgcttctgggaaatggtcgttatgtgcctttccacatacaagtgcctcagaaattctttgctgtcaagaacctacttcttctacctggctcctacacctacgagtggaacttccgaaaggatgtgaacatggtcctgcaaagttcccttggaaatgacctcagaacggatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagtccaaatgagtttgaaatcaagcgcactgtggacggggaaggatacaacgtggcacaatgcaacatgaccaaagactggttcctggttcagatgcttgccaattacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggctcaaacagatttaccagtttgagtacgaggggctcctgcgtcgcagtgcccttgctaccaaagaccgctgcatcaccctggagaagtctacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggtgctataccgcttcctaaacacccactcatcttactttcgttctcaccgcgcgcgcattgaaagggccaccgcgtttgaccgtatggatatgcaataagtcatgtaaaaccgtgttcaataaacagcactttatttttacatgcactgaggctctggttttgctcatttgtttcatcatttactcagaagtcgaatgggttctggcgggagtcagagtgacccgcgggcagggatacgttgcggaactgtaacctgttctgccacttgaactcggggattaccagcttgggaactggaatctcgggaaaggtgtcttgccacaactttctggtcagttgcatagcgccaagcaggtcaggagcagagatcttgaaatcacagttggggccggcattctggacacgggagttgcgatacactgggttgcaacactggaacactatcaacgctgggtgtcttacgcttgccaacacggttgggtcactgatggtagtcacatccaagtcttcagcattggccatcccaaagggggtcatcttacatgtctgcctgcccatcacgggagcgcagcctggcttgtggttgcaatcacaatgaatggggatcagcatcatcctggcttggtcgggagttatccctgggtacacagccttcatgaaggcttcgtactgcttaaaagcttcctgggccttacttccctcggtgtagaacatcccacaggacttgctggaaaattgattagtagtacagttggcatcattcacacaacagcgggcatcgttgttggccaactgaaccacatttctgccccagcggttttgggtgatcttggctctgtctggattctccttcatagcgcgctgcccgttctcgctcgccacatccatctcgataatgtggtccttctggatcatgatagtgccatgcaggcatttcaccttgccttcataatcggtgcatccatgagcccacagagcgcacccggtgcactcccaattattgtgggcgatctcagaataataatgtaccaatccctgcatgaatcttcccatcattgttgtcaaggtcttcatgctggtaaatgtcagcgggatgccacggtgctcctcgttcacatactggtggcagatacgcttgtattgctcgtgctgctctggcatcagcttgaaagaggttctcagatcattatccagcctgtacctttccattagcacagccatcacttccatgcccttctcccaggcagataccaggggcagactcaaaggattcctaacagcaataaaagtagctcctttagctatagggtcattcttgtcgatcttctcaacacttctcttgccatccttctcaatgatgcgcaccggggggtagctgaagcccacggccaccaactgagcctgttctctttcttcttcactatcctggctgatgtcttgcagagggacatgcttggtcttcctgggcttcttcttgggagggatcgggggaggactgttgctccgctccggagacagggatgactgcgaagtttcgcttaccaataccacctggctctcggtagaagaaccggaccccacacgacggtaggtgttcctcttcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaaacggaagagattgaggcagatgtcgagcaggacccgggctatgtgacgccggcggagcaccaggaggagctgaaacgctttctagacagagaggatgacgaccgcccagagcatcaagcagatggcgtttaccaggaggctgggatcagggatcatgtcgccgactacctcaccggccttggtggggaggacgtgctcctcaaacatctagcaaggcagtcgatcatagttaaagacgcattgctcgatctcactgaagtgcccatcagtgtggaagagcttagccgcgcctacgagctgaacctcttttcgcctcaggtaccccccaagcggcagccaaacggcacctgcgaggccaaccctcgactcaacttctatccagcttttactatccccgaagtgttggccacctaccacatctttttcaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacaccacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacctctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccgactagggcagagcgtcctgcacaccacccttaaaggggaggcccgccgtgactacatccgagactgtgtctacctctacctctgccatacctggcaaactggtatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagctgcagggtcccagaagtaaaggcgaggggtcttctccggggcagagtttgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctggcccaattgcaagccatccaaaaatctcgccaagaatttctgctaaaaaagggaaacggggtctaccttgaccctcagaccggtgaggagctcaacacaaggttcccccaggatgtcccatcgccgaggaagcaagaagttgaaggtgcagctgtcgcccccagaggatatgaaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgctcttccaccacggtgtaaacttcccccgcaatatcttgcattactaccgtcacctccacagcccctactgcagtcagcaagtcccggcaaccccgacagaaaaatacagcagcgacaacggtgaccagaaaaccagcagttagaaaatccacaacaagtgcaccaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgattagaggccgaggtatccagctcaacgacgagtcggttagctcttcgcttggtctgcgaccagacggagtcttccaaatcgccggctgtgggagatcttccttcactcctcgtcaggctgtgctgactttggagagttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcaccgagttcatctacttcgaactctccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctttcatccaggactctaactctaccttaccagcaccctccactactaaccttcccgaaacaaacaagcttgcatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctgatcctttgctacctatacacaccttgctgtgcatatttagtcatattgtgctgttggtttaagaaatgggggccatactagtcgtgcttgctttactttcgcttttgggtctgggctctgctaatctcaatcctctcgatcacgatccatgtttagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttccccagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacacccaatgaaaaaaacattccaaattcaatgattgcaattattgcggcggtggcattgggaatggcactaataataatatgcatgctcctatatgcttgttactataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacatcaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttccaaaaatcgctttaagtaattccacagccgctcccaatacaattcctaaatcaacaattggcatcattactgccgtggtagtgggattaatgattatatttttgtgtataatgtactacgcctgctgctatagaaaacatgaacaaaaaggtgatgcattactaaattttgatatttaattttttatagaattatgatattgtttcaatcaaataccactacctcctatgcatacacaaacattcagcctaaatacgctatgcaactagaaatcacaatactaattgtaattggaattcttaattaaatcgataagcttgttaacgaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggctggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacaaatgctagagcttatcgattgctactgaccatcgtctctcatacgagctcggtccgcagcgacaaaaattcacctgcatggtgggaatcaaccccatagttatcacccagcagtctggagatactaagggttgtatccagtgttcctgtgattccaccgagtgcatctacacactgctgaagaccctctgcggccttcgagacctcctacccatgaactaatcattgcccctaccttacccaatcaaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcagctcacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtaatacataaaaatgcatcgggatagtcttttaaagcgctttcacagtccaactgttgcggatgcgactccggagtctgaatcacggtcatctggaagaagaacgatgggaatcataatccgaaaacggaatcgggcgattgtgtctcatcaaacccacaagcaaccgctgtctgcgtcgctccgtgcgactgctgtttatgggatcggggtccgcagtgtcctgaagcatgattttaatagcccttaacattaactttctggtgcgatgcgcgcagcaacgcattctgatttcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatttgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaattgggctctggtgtaagggtgatgtctggcgcatgatgtggagcgtgcgcgcaaccttgtcataatggagttgcttcctgacattctcgtattttgtatagcaaaacgctgccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaaccgttgggatgcaaatacaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctcgaccctcgtaaaacctgtcattgtgattaaacaacagcaccgaaagttcctcgcggtggccagcatgaataattcttgatgaagcatacaatccagacatgttagcatcagttaaagagaaaaaacagccaacatagcctctgggtataattatgcttaattttaagtatagcaaagccacccctcgcggatacaaagtaaaaggcacaggagaataaaaaatataattatttctctgctgctgttcaggcaacgttgctcccggtccctctaaatagacatacaaagcctcatcagccatggcttaccaggcaaagtacagcgggcgcacaaagcacaagctctaaagaagctctaaaaacactctccaacctctccacaatatatacacaagccctaaactgacgtaatgggagtaaagtgaaaaaaaaataccgccaagcccaacacacaccccgaaactgcgtcagcaggaaaaagtacagtttcacttccgcattcccaacaagcgtaacttcctctttctcatggtacgtcacatccgattaacttgcaacgtcattttcccacggtcgcgccgccccttttagccgttaaccccgcagccaatcaccacacagcgcgcacttttttaaattacctcatttacatgttggcaccattccatcttgaggtatattatatagatag

SEQ ID NO: 31 - DNA, 36181 bp, Adenovirus
ctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttatgtgggaggagttatgttgcaagttattacggtaaatgtgacgtaaaacgaggtgtggtttgaacacggaagtagacagttttcccacgcttactgacaggatatgaggtagttttgggcggatgcaagtgaaaattctccattttcgcgcgaaaactaaatgaggaagtgaatttctgagtcatttcgcggttatgccagggtggagtatttgccgagggccgagtagactttgaccgtttacgtggaggtttcgattaccgtgtttttcacctaaatttccgcgtacggtgtcaaagttctgtgtttttacgtaggtgtcagctgatcgctgatcgctgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcaggcagcgctgcgtcctgctgcgcacgtgggaagccctggccgatgggctcgaatcgtgccagcgagaagagttttctcctccgcgccgcaagtcagttctgcgctttgaaaatgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctatttaataactgttgaatggtagatttatgtttttttcttgcgattttttgtaggtcctgtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaagctactgctagaaaacgcctcggacggagtctctggcctttggagattctggttcggtggtgatctagctaggctagtgtttaggataaaacaggactacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagtttttagatgttgtatgatgggtatgtggccaggggttgtcggcatggaagcagtaacacttatgaatattaggtttaaaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagaggccttatcagatgctgacctgcgctggtggacattgcaatattcttgctaccgtgcatatcgtttcacatgcacgcaaaaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacttgagacccgatcatttggtgcttgcctgcactggagcggagttcggttctagtggtgaagaaactgactaaagtgagtagtggggcaagatgtggatggggactttcaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattatggaagcatcgttgccaattccagttcctctaataacccttcaaccctggctgaggacaagctacttgttctcttggcgcagctcgaggccttaacccaacgcttaggcgaactgtctaagcaggtggcccagttgcgtgagcaaactgagtctgctgttgccacagcaaagtctaaataaagatctcaaatcaataaataaagaaatacttgatataaaacaaatgaatgtttatttgatttttcgcgcgcggtatgccctggaccatcggtctcgatcattgagaacgcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttcagagggggggatcatgtccacctgcggggctataaaaaataccgtttctggagccggggtgattaactgggacgagagcaaattcctaagcagctgagacttgccgcacccagtgggaccgtaaatgaccccaattacgggttgcagatggtagtttagggaacgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgattggcgccctgcatgtcggccaggtagcagtttaccatgagttcgtagttgagcgcctcggccgcgtggcctttggcacggagcttacctttggaagttttatggcaggcggggcagtagatacatttgagggcatacaacttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggtgatgttaagctggacgtactcgcgcgccacacatttccattcaggaaagatggttgtcagttcatccggaactattctgattcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacatcgcccccctctgatgcttgctcgcacatagtcatagagttcatgtgagggggcaagaagacccgggcccagattggtgcggttgggtttttccgccctgtaaacgatctggcgaaagatggcatgggaattggaagagatagtaggtctctggaatatgttaaaatgggcatgaggtaagcctacagagtcccttatgaagtgggcatatgactcttgcagcttggctaccagctcggcggtgatgagtacatccagggcacagtagtcgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgaggaacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttaaggaaggaggaccagaggtccactgccagtgctgtttgtaactggtcccggtactgacgaaaatgctgtccgactgccatcttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcaccttatgaatgagttgtacctgacttcctttgacgagaaatttcagtggaaaattgaggcctggcgcttgtacctcgcgctttactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattaacttgcatgatcttttggagggcgtgagggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttaaaaaactgggagttacgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgggagggtgagacgatgctgctggtgatgaaattaaaataggcagttttgagacggcggatggtggcgaggagcaccaggtctttgggtccggcttgttggatacgcaggcgatgagccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtccacgaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccaatgagaaagtgtggcggtggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggtctgggggaacgtgaacgggttgggtcgcggtgtaccccggttcgagtccaaagctaagcgatcacgctcggatcggccggagccgcggctaacgtggtattggctatcccgtctcgacccagccgacgaatatccagggtacggagtagagtcgtttttgctgctttttcctggacgtgtgccattgccacgtcaagctttagaacgctcagttctcgggccgtgagtggctcgcgcccgtagtctggagaatcagtcgccagggttgcgttgcggtatgccccggttggagcctaagcgcggctcgtatcggccggtttccgcgacaagcgagggtttggcagccccgttatttccaagaccccgccagccgacttctccagtttacgggagcgagcccttttttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccccagcagaacctgttcagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttctgccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcgattccagcgcgacgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggggatcgcgcgaccgtgtctagcttgctgactcccaactcccgcctgctgctgctgctggtatccccctttactgacagcggtagcattgaccgcaactcgtacttgggctacctgcttaacctgtatcgcgaggccataggacagagccaggtggacgagcagacctatcaagaaatcacccaagtgagccgcgccctgggtcaggaagacacgggcagtttggaagccaccctgaacttcttgctaaccaaccggtcacagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattttccccgcctcccggttatacagtttggaagaaggaagggggcgatagaagacactcttccgtgtcgctatccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgctgaggccagagagggaaaagaacttccccaacaatggaatagagagtctggtggataagatgagtagatggaagacctatgcgcaggatcacagagacgagcccaggatcttgggggctacaagcagaccgatccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcggcgatgatacagcccccactggaggctcccttcgtacccccacggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggtgtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgatgatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacagcctaccgcagttggtacctgtcctacaattacggtaaccctgagaaaggaataaggtcttggacactgctcaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcaagcgctctacccagcatcctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagccgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggctgtgtccattcctttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttcagtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcagacgctggtgacgcgcgcagacgagcccccttcatatgaggaggcagtaaagctcggaatgcccactaccaggcctgtagctcacatggctaccggggtgatgaaaccttctcagtcacatcgacccgccaccttggacttgcctcctccccctgcttctgcggcgcctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcagttcgcccgtgcaacagacacctacttcagtatggggaacaaatttagaaaccccacagtggcgcccacccacgatgtgaccaccgaccgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccagaaacgtctaataactctcatgcaaatttgggtcaacaagccatgcctaacagacccaattacattggcttcagggataacttcgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctgaatggcataggaccagggcacacatatcaaggcattaaagttaaaaccgatgacactaatggatgggaaaaagatgctaatgttgctccagctaatgaaataaccataggcaacaacctggctatggaaattaatatccaagctaacctttggagaagttttctgtactctaatgtggctttgtaccttccagatgtttacaagtacacgccacctaacattactttgcccactaacaccaacacctatgagtacatgaacgggcgagtggtatccccatccctggttgattcatacatcaacattggcgccaggtggtctcttgacccaatggacaatgtgaatccattcaaccaccaccgcaatgctggtctgcgctacaggtccatgcttctgggaaatggtcgttatgtgcctttccacatacaagtgcctcagaaattctttgctgtcaagaacctacttcttctacctggctcctacacctacgagtggaacttccgaaaggatgtgaacatggtcctgcaaagttcccttggaaatgacctcagaacggatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagtccaaatgagtttgaaatcaagcgcactgtggacggggaaggatacaacgtggcacaatgcaacatgaccaaagactggttcctggttcagatgcttgccaattacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggctcaaacagatttaccagtttgagtacgaggggctcctgcgtcgcagtgcccttgctaccaaagaccgctgcatcaccctggagaagtctacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggtgctataccgcttcctaaacacccactcatcttactttcgttctcaccgcgcgcgcattgaaagggccaccgcgtttgaccgtatggatatgcaataagtcatgtaaaaccgtgttcaataaacagcactttatttttacatgcactgaggctctggttttgctcatttgtttcatcatttactcagaagtcgaatgggttctggcgggagtcagagtgacccgcgggcagggatacgttgcggaactgtaacctgttctgccacttgaactcggggattaccagcttgggaactggaatctcgggaaaggtgtcttgccacaactttctggtcagttgcatagcgccaagcaggtcaggagcagagatcttgaaatcacagttggggccggcattctggacacgggagttgcgatacactgggttgcaacactggaacactatcaacgctgggtgtcttacgcttgccaacacggttgggtcactgatggtagtcacatccaagtcttcagcattggccatcccaaagggggtcatcttacatgtctgcctgcccatcacgggagcgcagcctggcttgtggttgcaatcacaatgaatggggatcagcatcatcctggcttggtcgggagttatccctgggtacacagccttcatgaaggcttcgtactgcttaaaagcttcctgggccttacttccctcggtgtagaacatcccacaggacttgctggaaaattgattagtagtacagttggcatcattcacacaacagcgggcatcgttgttggccaactgaaccacatttctgccccagcggttttgggtgatcttggctctgtctggattctccttcatagcgcgctgcccgttctcgctcgccacatccatctcgataatgtggtccttctggatcatgatagtgccatgcaggcatttcaccttgccttcataatcggtgcatccatgagcccacagagcgcacccggtgcactcccaattattgtgggcgatctcagaataataatgtaccaatccctgcatgaatcttcccatcattgttgtcaaggtcttcatgctggtaaatgtcagcgggatgccacggtgctcctcgttcacatactggtggcagatacgcttgtattgctcgtgctgctctggcatcagcttgaaagaggttctcagatcattatccagcctgtacctttccattagcacagccatcacttccatgcccttctcccaggcagataccaggggcagactcaaaggattcctaacagcaataaaagtagctcctttagctatagggtcattcttgtcgatcttctcaacacttctcttgccatccttctcaatgatgcgcaccggggggtagctgaagcccacggccaccaactgagcctgttctctttcttcttcactatcctggctgatgtcttgcagagggacatgcttggtcttcctgggcttcttcttgggagggatcgggggaggactgttgctccgctccggagacagggatgactgcgaagtttcgcttaccaataccacctggctctcggtagaagaaccggaccccacacgacggtaggtgttcctcttcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaaacggaagagattgaggcagatgtcgagcaggacccgggctatgtgacgccggcggagcaccaggaggagctgaaacgctttctagacagagaggatgacgaccgcccagagcatcaagcagatggcgtttaccaggaggctgggatcagggatcatgtcgccgactacctcaccggccttggtggggaggacgtgctcctcaaacatctagcaaggcagtcgatcatagttaaagacgcattgctcgatctcactgaagtgcccatcagtgtggaagagcttagccgcgcctacgagctgaacctcttttcgcctcaggtaccccccaagcggcagccaaacggcacctgcgaggccaaccctcgactcaacttctatccagcttttactatccccgaagtgttggccacctaccacatctttttcaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacaccacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacctctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccgactagggcagagcgtcctgcacaccacccttaaaggggaggcccgccgtgactacatccgagactgtgtctacctctacctctgccatacctggcaaactggtatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagctgcagggtcccagaagtaaaggcgaggggtcttctccggggcagagtttgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctggcccaattgcaagccatccaaaaatctcgccaagaatttctgctaaaaaagggaaacggggtctaccttgaccctcagaccggtgaggagctcaacacaaggttcccccaggatgtcccatcgccgaggaagcaagaagttgaaggtgcagctgtcgcccccagaggatatgaaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgctcttccaccacggtgtaaacttcccccgcaatatcttgcattactaccgtcacctccacagcccctactgcagtcagcaagtcccggcaaccccgacagaaaaatacagcagcgacaacggtgaccagaaaaccagcagttagaaaatccacaacaagtgcaccaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgattagaggccgaggtatccagctcaacgacgagtcggttagctcttcgcttggtctgcgaccagacggagtcttccaaatcgccggctgtgggagatcttccttcactcctcgtcaggctgtgctgactttggagagttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcaccgagttcatctacttcgaactctccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctttcatccaggactctaactctaccttaccagcaccctccactactaaccttcccgaaacaaacaagcttgcatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctgatcctttgctacctatacacaccttgctgtgcatatttagtcatattgtgctgttggtttaagaaatgggggccatactagtcgtgcttgctttactttcgcttttgggtctgggctctgctaatctcaatcctctcgatcacgatccatgtttagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttccccagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacacccaatgaaaaaaacattccaaattcaatgattgcaattattgcggcggtggcattgggaatggcactaataataatatgcatgctcctatatgcttgttactataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacatcaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttccaaaaatcgctttaagtaattccacagccgctcccaatacaattcctaaatcaacaattggcatcattactgccgtggtagtgggattaatgattatatttttgtgtataatgtactacgcctgctgctatagaaaacatgaacaaaaaggtgatgcattactaaattttgatatttaattttttatagaattatgatattgtttcaatcaaataccactacctcctatgcatacacaaacattcagcctaaatacgctatgcaactagaaatcacaatactaattgtaattggaattcttaattaatggtaccatccggacaaagcctgcgcgcgccccgccccgccattggccgtaccgccccgcgccgccgccccatcccgcccctcgccgccgggtccggcgcgttaaagccaataggagccgccgccgttgttcccgtcacggccggggcagccaattgtggcggcgctcggcggctcgtggctctttcgcggcaaaaaggatttggcgcgtaaaagtggccgggactttgcaggcagcggcggccgggggcggagcgggatcgagccctcgccgctagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggctggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacaaatgctagagcttatcgattgctactgaccatcgtctctcatacgagctcggtccgcagcgacaaaaattcacctgcatggtgggaatcaaccccatagttatcacccagcagtctggagatactaagggttgtatccagtgttcctgtgattccaccgagtgcatctacacactgctgaagaccctctgcggccttcgagacctcctacccatgaactaatcattgcccctaccttacccaatcaaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcagctcacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtaatacataaaaatgcatcgggatagtcttttaaagcgctttcacagtccaactgttgcggatgcgactccggagtctgaatcacggtcatctggaagaagaacgatgggaatcataatccgaaaacggaatcgggcgattgtgtctcatcaaacccacaagcaaccgctgtctgcgtcgctccgtgcgactgctgtttatgggatcggggtccgcagtgtcctgaagcatgattttaatagcccttaacattaactttctggtgcgatgcgcgcagcaacgcattctgatttcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatttgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaattgggctctggtgtaagggtgatgtctggcgcatgatgtggagcgtgcgcgcaaccttgtcataatggagttgcttcctgacattctcgtattttgtatagcaaaacgctgccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaaccgttgggatgcaaatacaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctcgaccctcgtaaaacctgtcattgtgattaaacaacagcaccgaaagttcctcgcggtggccagcatgaataattcttgatgaagcatacaatccagacatgttagcatcagttaaagagaaaaaacagccaacatagcctctgggtataattatgcttaattttaagtatagcaaagccacccctcgcggatacaaagtaaaaggcacaggagaataaaaaatataattatttctctgctgctgttcaggcaacgttgctcccggtccctctaaatagacatacaaagcctcatcagccatggcttaccaggcaaagtacagcgggcgcacaaagcacaagctctaaagaagctctaaaaacactctccaacctctccacaatatatacacaagccctaaactgacgtaatgggagtaaagtgaaaaaaaaataccgccaagcccaacacacaccccgaaactgcgtcagcaggaaaaagtacagtttcacttccgcattcccaacaagcgtaacttcctctttctcatggtacgtcacatccgattaacttgcaacgtcattttcccacggtcgcgccgccccttttagccgttaaccccgcagccaatcaccacacagcgcgcacttttttaaattacctcatttacatgttggcaccattccatcttgaggtatattatatagatag

The invention claimed is:

1. A method of treating tumors in a subject, wherein the method comprises:

separate administration of an adoptive T-cell therapeutic composition and an oncolytic adenoviral vector coding for at least one cytokine to a subject, wherein the administration of the adoptive T-cell therapeutic composition is intravenous, intratumoral and/or intraperitoneal, wherein the administration of the oncolytic adenoviral vector is intratumoral and wherein said oncolytic adenoviral vector is an adenovirus serotype 5 (Ad5) vector comprising a 5/3 chimeric fiber knob, E2F1 or CMV promoter for tumor specific expression of E1A, a 24 bp deletion (D24) in the Rb binding constant region 2 of adenoviral E1, a nucleic acid sequence deletion of viral gp19k and 6.7 k reading frames, and a nucleic acid sequence encoding at least TNFalpha or IL-2 transgene in the place of the deleted gp19k/6.7K in the E3 region resulting in replication-associated control of transgene expression under the viral E3 promoter, wherein said vector infects tumor cells in said tumor and expresses the TNFalpha or IL-2 transgene in the infected tumor cells, and wherein the infection with said vector results in enhanced trafficking of T-cells to the tumor and consequently in decreased tumor size when compared to non-infected tumor cells, and wherein the infected tumor cells are defective in the Rb-p16 pathway.

2. The method according to claim 1, wherein the adoptive T-cell therapeutic composition comprises a cell type selected from a group consisting of a tumor infiltrating lymphocyte (TIL), T-cell receptor modified lymphocytes and chimeric antigen receptor modified lymphocytes.

3. The method according to claim 1, wherein the tumor is related to a cancer selected from a group consisting of nasopharyngeal cancer, synovial cancer, hepatocellular cancer, renal cancer, cancer of connective tissues, melanoma, lung cancer, bowel cancer, colon cancer, rectal cancer, colorectal cancer, brain cancer, throat cancer, oral cancer, liver cancer, bone cancer, pancreatic cancer, choriocarcinoma, gastrinoma, pheochromocytoma, prolactinoma, T-cell leukemia/lymphoma, neuroma, von Hippel-Lindau disease, Zollinger-Ellison syndrome, adrenal cancer, anal cancer, bile duct cancer, bladder cancer, ureter cancer, brain cancer, oligodendroglioma, neuroblastoma, meningioma, spinal cord tumor, bone cancer, osteochondroma, chondrosarcoma, Ewing's sarcoma, cancer of unknown primary site, carcinoid, carcinoid of gastrointestinal tract, fibrosarcoma, breast cancer, Paget's disease, cervical cancer, colorectal cancer, rectal cancer, esophagus cancer, gall bladder cancer, head cancer, eye cancer, neck cancer, kidney cancer, Wilms' tumor, liver cancer, Kaposi's sarcoma, prostate cancer, lung cancer, testicular cancer, Hodgkin's disease, non-Hodgkin's lymphoma, oral cancer, skin cancer, mesothelioma, multiple myeloma, ovarian cancer, endocrine pancreatic cancer, glucagonoma, pancreatic cancer, parathyroid cancer, penis cancer, pituitary cancer, soft tissue sarcoma, retinoblastoma, small intestine cancer, stomach cancer, thymus cancer, thyroid cancer, trophoblastic cancer, hydatidiform mole, uterine cancer, endometrial cancer, vagina cancer, vulva cancer, acoustic neuroma, mycosis fungoides, insulinoma, carcinoid syndrome, somatostatinoma, gum cancer, heart cancer, lip cancer, meninges cancer, mouth cancer, nerve cancer, palate cancer, parotid gland cancer, peritoneum cancer, pharynx cancer, pleural cancer, salivary gland cancer, tongue cancer and tonsil cancer.

4. The method according to claim 1, wherein the subject is a human or an animal.

5. The method according to claim 1, wherein the administration(s) of the adoptive T-cell therapeutic composition and the oncolytic adenoviral vector to the subject is (are) conducted simultaneously or consecutively, in any order.

6. The method according to claim 5, wherein there is a time period of one minute to four weeks between the consecutive administration of the adoptive T-cell therapeutic composition and the oncolytic viral vector and/or there are several administrations of the adoptive T-cell therapeutic composition and the oncolytic adenoviral vectors.

7. The method according to claim 1, wherein the administration of the adoptive T-cell therapeutic composition is intravenous.

8. The method according to claim 1, wherein the oncolytic adenoviral vector that encodes for TNF-alpha or IL-2 further comprises one or more cytokines.

9. The method according to claim 8, wherein the oncolytic adenoviral vector that encodes for TNF-alpha or IL-2 further comprises any two or more cytokines selected from a cytokine group consisting of interferon alpha, interferon beta, interferon gamma, complement C5a, GMCSF, IL-2, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5 (RANTES), CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2, or the oncolytic adenoviral vector codes for IL-2 and further comprises a cytokine or cytokines selected from a cytokine group consisting of interferon alpha, interferon beta, interferon gamma, complement C5a, GMCSF, TNFalpha, CD40L, IL12, IL-23, IL15, IL17, CCL1, CCL11, CCL12, CCL13, CCL14-1, CCL14-2, CCL14-3, CCL15-1, CCL15-2, CCL16, CCL17, CCL18, CCL19, CCL19, CCL2, CCL20, CCL21, CCL22, CCL23-1, CCL23-2, CCL24, CCL25-1, CCL25-2, CCL26, CCL27, CCL28, CCL3, CCL3L1, CCL4, CCL4L1, CCL5, CCL6, CCL7, CCL8, CCL9, CCR10, CCR2, CCR5, CCR6, CCR7, CCR8, CCRL1, CCRL2, CX3CL1, CX3CR, CXCL1, CXCL10, CXCL11, CXCL12, CXCL13, CXCL14, CXCL15, CXCL16, CXCL2, CXCL3, CXCL4, CXCL5, CXCL6, CXCL7, CXCL8, CXCL9, CXCL9, CXCR1, CXCR2, CXCR4, CXCR5, CXCR6, CXCR7 and XCL2.

10. The method according to claim 8, wherein the oncolytic adenoviral vector comprises an internal ribosomal entry site (IRES) or a ribosome shunt site 2A between the two transgenes.

11. The method according to claim 1, wherein the oncolytic adenoviral vector is administered in an amount of $1 \times 10^{10}$–$1 \times 10^{14}$ virus particles.

12. A method of increasing the efficacy of adoptive T-cell therapy in a subject comprising:
intratumorally administering an oncolytic adenoviral vector to a subject who has been administered an adoptive T-cell therapeutic composition, wherein said oncolytic adenoviral vector is an adenovirus serotype 5 (Ad5) vector comprising:
i) a 5/3 chimeric fiber knob,
ii) E2F1 promoter for tumor specific expression of E1A,
iii) a 24 bp deletion (D24) in the Rb binding constant region 2 of adenoviral E1,
iv) a nucleic acid sequence deletion of viral gp19k and 6.7 k reading frames, and
v) a nucleic acid sequence encoding at least TNFalpha or IL-2 transgene in the place of the deleted 19k/6.7K in the E3 region resulting in replication-associated control of transgene expression under the viral E3 promoter, wherein said vector infects tumor cells in said tumor and expresses the TNFalpha or IL-2 transgene in the infected tumor cells, and wherein the infection with said vector results in enhanced trafficking of T-cells to the tumor and consequently in decreased tumor size when compared to non-infected tumor cells, and wherein the infected tumor cells are defective in the Rb-p16 pathway, thereby increasing the efficacy of adoptive T-cell therapy.

13. A method of treating a tumor in a subject, wherein the method comprises intratumoral administration of an oncolytic adenoviral vector to a subject comprising a tumor, wherein said oncolytic adenoviral vector comprises:
i) an adenovirus serotype 5 (Ad5) nucleic acid backbone comprising a 5/3 chimeric fiber knob;
ii) E2F1 promoter for tumor specific expression of El A;
iii) a 24 bp deletion (D24) in the Rb binding constant region 2 of adenoviral E1;

iv) a nucleic acid sequence deletion of viral gp19k and 6.7 k reading frames; and v) a nucleic acid sequence encoding TNFalpha and IL-2 transgenes in the place of the deleted gp19k/6.7K in the E3 region resulting in replication-associated control of transgene expression under the viral E3 promoter, wherein the adenoviral vector comprises an internal ribosomal entry site (IRES) or a ribosome shunt site 2A between the two transgenes, wherein said vector infects tumor cells in said tumor and expresses the TNFalpha and IL-2 transgenes in the infected tumor cells, and wherein the infection with said vector results in enhanced trafficking of T-cells to the tumor and consequently in decreased tumor size when compared to non-infected tumor cells, and wherein the infected tumor cells are defective in the Rb-p16 pathway.

14. The method according to claim 1, wherein the method further comprises administration of concurrent or sequential radiotherapy, monoclonal antibodies, chemotherapy or other anti-cancer drugs or interventions to the subject.

15. The method according to claim 8, wherein one of the cytokines is IL-2.

16. The method according to claim 8, wherein one of the cytokines is TNFalpha.

17. The method according to claim 1, wherein the oncolytic adenoviral vector is injected into the tumor.

18. The method according to 12, wherein the oncolytic adenoviral vector is injected into the tumor.

19. The method according to claim 1, wherein said nucleic acid sequence encodes at least TNFalpha and IL-2 transgenes.

20. The method according to claim 1, wherein the tumor is selected from the group consisting of a melanoma tumor and a pancreatic cancer tumor.

21. The method according to claim 20, wherein the tumor is a melanoma tumor.

22. The method according to claim 20, wherein the tumor is a pancreatic cancer tumor.

23. A method of treating tumors in a subject, wherein the method comprises:

separate administration of an adoptive T-cell therapeutic composition and an oncolytic adenoviral vector to a subject, wherein the administration of the T-cell therapeutic composition is intravenous, intratumoral and/or intraperitoneal, wherein the administration of the oncolytic adenoviral vector is intratumoral and wherein said oncolytic adenoviral vector is an adenovirus serotype 5 (Ad5) vector comprising a 5/3 chimeric fiber knob, E2F1 or CMV promoter for tumor specific expression of E1A, a 24 bp deletion (D24) in the Rb binding constant region 2 of adenoviral E1, a nucleic acid sequence deletion of viral gp19k and 6.7 k reading frames, and a nucleic acid sequence encoding TNFalpha and IL-2 transgenes in the place of the deleted gp19k/6.7K in the E3 region resulting in replication-associated control of transgene expression under the viral E3 promoter, wherein the adenoviral vector comprises an internal ribosomal entry site (IRES) or a ribosome shunt site 2A between the two transgenes, wherein said vector infects tumor cells in said tumor and express TNFalpha and IL-2 transgenes in the infected tumor, and wherein the infection with said vector results in enhanced trafficking of T-cells to the tumor and consequently in decreased tumor size when compared to non-infected tumor cells, and wherein the infected tumor cells are defective in the Rb-p16 pathway.

24. The method according to claim 23, wherein the tumor is selected from a group consisting of a melanoma tumor and a pancreatic cancer tumor.

* * * * *